US010017760B2

(12) United States Patent
Gill et al.

(10) Patent No.: US 10,017,760 B2
(45) Date of Patent: *Jul. 10, 2018

(54) METHODS FOR GENERATING BARCODED COMBINATORIAL LIBRARIES

(71) Applicants: The Regents of the University of Colorado, a body corporate, Denver, CO (US); Inscripta, Inc., Boulder, CO (US)

(72) Inventors: Ryan T. Gill, Denver, CO (US); Andrew Garst, Boulder, CO (US); Tanya Elizabeth Warnecke Lipscomb, Boulder, CO (US); Marcelo Colika Bassalo, Boulder, CO (US); Ramsey Ibrahim Zeitoun, San Francisco, CA (US)

(73) Assignees: Inscripta, Inc., Boulder, CO (US); The Regents of the University of Colorado, a Body Corporate, Denver, CO (US)

(*) Notice: Subject to any disclaimer, the term of this patent is extended or adjusted under 35 U.S.C. 154(b) by 0 days.

This patent is subject to a terminal disclaimer.

(21) Appl. No.: 15/632,222

(22) Filed: Jun. 23, 2017

(65) Prior Publication Data
US 2017/0369870 A1 Dec. 28, 2017

Related U.S. Application Data

(60) Provisional application No. 62/354,516, filed on Jun. 24, 2016, provisional application No. 62/367,386, filed on Jul. 27, 2016, provisional application No. 62/483,930, filed on Apr. 10, 2017.

(51) Int. Cl.
C12N 15/09 (2006.01)
C12N 15/10 (2006.01)
C12N 15/11 (2006.01)
C12N 15/63 (2006.01)
C12N 15/64 (2006.01)
C12N 15/70 (2006.01)
C12N 15/74 (2006.01)
C12N 15/79 (2006.01)
C12N 15/81 (2006.01)
C12N 15/82 (2006.01)
C12N 15/85 (2006.01)

(52) U.S. Cl.
CPC ....... C12N 15/1065 (2013.01); C12N 15/102 (2013.01); C12N 15/1079 (2013.01); C12N 15/1082 (2013.01); C12N 15/11 (2013.01); C12N 2310/20 (2017.05)

(58) Field of Classification Search
None
See application file for complete search history.

(56) References Cited

U.S. PATENT DOCUMENTS

| 6,562,594 B1 | 5/2003 | Short |
| 8,153,432 B2 | 4/2012 | Church et al. |
| 8,569,041 B2 | 10/2013 | Church et al. |
| 8,906,616 B2 | 12/2014 | Zhang et al. |
| 2008/0287317 A1 | 11/2008 | Boone |
| 2010/0034924 A1 | 2/2010 | Fremaux et al. |
| 2010/0305001 A1 | 12/2010 | Kern et al. |
| 2014/0068797 A1 | 3/2014 | Doudna et al. |
| 2014/0089681 A1 | 3/2014 | Goto et al. |
| 2014/0121118 A1 | 5/2014 | Warner |
| 2014/0199767 A1 | 7/2014 | Barrangou et al. |
| 2014/0273226 A1 | 9/2014 | Wu |
| 2014/0273232 A1 | 9/2014 | Zhang et al. |
| 2014/0295557 A1 | 10/2014 | Joung et al. |
| 2015/0031133 A1 | 1/2015 | Church et al. |
| 2015/0031134 A1 | 1/2015 | Zhang et al. |
| 2015/0064138 A1 | 3/2015 | Lu et al. |
| 2015/0079680 A1 | 3/2015 | Bradley et al. |
| 2015/0098954 A1 | 4/2015 | Hyde et al. |
| 2015/0133315 A1 | 5/2015 | Jacobson et al. |
| 2015/0159174 A1 | 6/2015 | Frendewey et al. |
| 2015/0176013 A1 | 6/2015 | Musunuru et al. |
| 2015/0201634 A1 | 7/2015 | Fremaux et al. |
| 2015/0225773 A1 | 8/2015 | Farmer et al. |
| 2015/0247150 A1 | 9/2015 | Zhang et al. |
| 2015/0353905 A1 | 12/2015 | Weiss et al. |

(Continued)

FOREIGN PATENT DOCUMENTS

| EP | 2764103 A2 | 8/2014 |
| EP | 2825654 A1 | 1/2015 |

(Continued)

OTHER PUBLICATIONS

Hsu et al., "DNA targeting specificity of RNA-guided Cas9 nucleases" 31(9) Nature Biotechnology 827-834 (2013).*
Abudayyeh, et al. C2c2 is a single-component programmable RNA-guided RNA-targeting CRISPR effector. Science. Jun. 2, 2016. DOI: 10.1126/science.aaf557.
Agresti, et al. Ultrahigh-throughput screening in drop-based microfluidics for directed evolution. Proc Natl Acad Sci U S A. Mar. 2, 2010;107(9):4004-9. doi: 10.1073/pnas.0910781107. Epub Feb. 8, 2010.
Alper, et al. Engineering yeast transcription machinery for improved ethanol tolerance and production. Science. Dec. 8, 2006;314(5805):1565-8.

(Continued)

Primary Examiner — Nancy J Leith
(74) Attorney, Agent, or Firm — Wilson Sonsini Goodrich & Rosati

(57) ABSTRACT

Provided herein are methods and composition for trackable genetic variant libraries. Further provided herein are methods and compositions for recursive engineering. Further provided herein are methods and compositions for multiplex engineering. Further provided herein are methods and compositions for enriching for editing and trackable engineered sequences and cells using nucleic acid-guided nucleases.

12 Claims, 45 Drawing Sheets
(44 of 45 Drawing Sheet(s) Filed in Color)

(56) References Cited

U.S. PATENT DOCUMENTS

| | | |
|---|---|---|
| 2015/0353917 A1 | 12/2015 | Miller |
| 2015/0368639 A1 | 12/2015 | Gill et al. |
| 2016/0024523 A1 | 1/2016 | Joung et al. |
| 2016/0024529 A1 | 1/2016 | Carstens |
| 2016/0053272 A1 | 2/2016 | Wurtzel et al. |
| 2016/0053304 A1 | 2/2016 | Wurtzel et al. |
| 2016/0060653 A1 | 3/2016 | Doudna et al. |
| 2016/0060654 A1 | 3/2016 | Doudna et al. |
| 2016/0068864 A1 | 3/2016 | Doudna et al. |
| 2016/0076093 A1 | 3/2016 | Shendure et al. |
| 2016/0102322 A1 | 4/2016 | Ravinder et al. |
| 2016/0115488 A1 | 4/2016 | Zhang et al. |
| 2016/0115489 A1 | 4/2016 | Zhang et al. |
| 2016/0160210 A1 | 6/2016 | Mali et al. |
| 2016/0168592 A1 | 6/2016 | Church et al. |
| 2016/0186168 A1 | 6/2016 | Konieczka et al. |
| 2016/0264995 A1 | 9/2016 | Yamamoto et al. |
| 2016/0289673 A1 | 10/2016 | Huang et al. |
| 2016/0289675 A1 | 10/2016 | Ryan et al. |
| 2016/0298096 A1 | 10/2016 | Charpentier et al. |
| 2016/0298097 A1 | 10/2016 | Chavez et al. |
| 2016/0298134 A1 | 10/2016 | Chen et al. |
| 2016/0298135 A1 | 10/2016 | Chen et al. |
| 2016/0298138 A1 | 10/2016 | Chen et al. |
| 2016/0333389 A1 | 11/2016 | Liu et al. |
| 2016/0367702 A1 | 12/2016 | Hoge et al. |
| 2017/0002339 A1 | 1/2017 | Barrangou et al. |
| 2017/0044569 A9 | 2/2017 | Church et al. |
| 2017/0051276 A1 | 2/2017 | May et al. |
| 2017/0051310 A1 | 2/2017 | Doudna et al. |
| 2017/0051311 A1 | 2/2017 | Dalia et al. |
| 2017/0067046 A1 | 3/2017 | Gill et al. |
| 2017/0073705 A1 | 3/2017 | Chen et al. |
| 2017/0080107 A1 | 3/2017 | Chivukula et al. |
| 2017/0114334 A1 | 4/2017 | May et al. |
| 2017/0114369 A1 | 4/2017 | Donohoue et al. |
| 2017/0145425 A1 | 5/2017 | Kim et al. |
| 2017/0159045 A1 | 6/2017 | Serber et al. |
| 2017/0175143 A1 | 6/2017 | Tolar et al. |
| 2017/0191123 A1 | 7/2017 | Kim et al. |
| 2017/0198302 A1 | 7/2017 | Feng et al. |
| 2017/0204407 A1 | 7/2017 | Gilbert et al. |
| 2017/0226533 A1 | 8/2017 | Frisch et al. |
| 2017/0233752 A1 | 8/2017 | Shiboleth et al. |
| 2017/0240922 A1 | 8/2017 | Gill et al. |

FOREIGN PATENT DOCUMENTS

| | | |
|---|---|---|
| EP | 2828386 A1 | 1/2015 |
| EP | 2840140 A1 | 2/2015 |
| EP | 2848690 A1 | 3/2015 |
| EP | 2898075 A1 | 7/2015 |
| EP | 3009511 A2 | 4/2016 |
| EP | 3064585 A1 | 9/2016 |
| EP | 2840140 B1 | 11/2016 |
| EP | 3144390 A1 | 3/2017 |
| WO | WO-03106654 A2 | 12/2003 |
| WO | WO-2007144770 A2 | 12/2007 |
| WO | WO-2012142591 A2 | 10/2012 |
| WO | WO-2013176772 A1 | 11/2013 |
| WO | WO-2013176915 A1 | 11/2013 |
| WO | WO-2014022702 A2 | 2/2014 |
| WO | WO-2014065596 A1 | 5/2014 |
| WO | WO-2014093595 A1 | 6/2014 |
| WO | WO-2014093661 A2 | 6/2014 |
| WO | WO-2014099744 A1 | 6/2014 |
| WO | WO-2014110006 A1 | 7/2014 |
| WO | WO-2014143381 A1 | 9/2014 |
| WO | WO-2014150624 A1 | 9/2014 |
| WO | WO-2014191128 A1 | 12/2014 |
| WO | WO-2015006290 A1 | 1/2015 |
| WO | WO-2015006747 A2 | 1/2015 |
| WO | WO-2015013583 A2 | 1/2015 |
| WO | WO-2015017866 A1 | 2/2015 |
| WO | WO-2015048577 A2 | 4/2015 |
| WO | WO-2015048690 A1 | 4/2015 |
| WO | WO-2015068785 A1 | 5/2015 |
| WO | WO-2015069682 A2 | 5/2015 |
| WO | WO-2015070062 A1 | 5/2015 |
| WO | WO-2015071474 A2 | 5/2015 |
| WO | WO-2015089354 A1 | 6/2015 |
| WO | WO-2015123339 A1 | 8/2015 |
| WO | WO-2015153889 A2 | 10/2015 |
| WO | WO-2015159086 A1 | 10/2015 |
| WO | WO-2015159087 A1 | 10/2015 |
| WO | WO-2015179540 A1 | 11/2015 |
| WO | WO-2015191693 A2 | 12/2015 |
| WO | WO-2015195798 A1 | 12/2015 |
| WO | WO-2015198020 A1 | 12/2015 |
| WO | WO-2015191693 A3 | 2/2016 |
| WO | WO-2016040594 A1 | 3/2016 |
| WO | WO-2016070037 A2 | 5/2016 |
| WO | WO-2016099887 A1 | 6/2016 |
| WO | WO-2016100955 A2 | 6/2016 |
| WO | WO-2016166340 A1 | 10/2016 |
| WO | WO-2016186946 A1 | 11/2016 |
| WO | WO-2016186953 A1 | 11/2016 |
| WO | WO-2016205613 A1 | 12/2016 |
| WO | WO-2017004261 A1 | 1/2017 |
| WO | WO-2017015015 A1 | 1/2017 |
| WO | WO-2017019867 A1 | 2/2017 |
| WO | WO-2017031483 A1 | 2/2017 |
| WO | WO-2017053713 A1 | 3/2017 |
| WO | WO-2017068120 A1 | 4/2017 |
| WO | WO-2017089767 A1 | 6/2017 |
| WO | WO-2017100343 A1 | 6/2017 |
| WO | WO-2017100377 A1 | 6/2017 |
| WO | WO-2017109167 A2 | 6/2017 |
| WO | WO-2017223538 A1 | 12/2017 |

OTHER PUBLICATIONS

Alper, et al. Global transcription machinery engineering: a new approach for improving cellular phenotype. Metab Eng. May 2007;9(3):258-67. Epub Jan. 8, 2007.

Baba, et al. Construction of *Escherichia coli* K-12 in-frame, single-gene knockout mutants: the Keio collection. Mol Syst Biol. 2006;2:2006.0008. Epub Feb. 21, 2006.

Bakan, et al. ProDy: protein dynamics inferred from theory and experiments. Bioinformatics. Jun. 1, 2011;27(11):1575-7. doi: 10.1093/bioinformatics/btr168. Epub Apr. 5, 2011.

Basak, et al. Enhancing *E. coli* tolerance towards oxidative stress via engineering its global regulator cAMP receptor protein (CRP). PLoS One. 2012;7(12):e51179. doi: 10.1371/journal.pone.0051179. Epub Dec. 14, 2012.

Bateman, et al. The Pfam protein families database. Nucleic Acids Res. Jan. 1, 2004;32(Database issue):D138-41.

Bhabha, et al. Divergent evolution of protein conformational dynamics in dihydrofolate reductase. Nat Struct Mol Biol. Nov. 2013;20(11):1243-9. doi: 10.1038/nsmb.2676. Epub Sep. 29, 2013.

Bhaya, et al. CRISPR-Cas systems in bacteria and archaea: versatile small RNAs for adaptive defense and regulation. Annu Rev Genet. 2011;45:273-97. doi: 10.1146/annurev-genet-110410-132430.

Bikard, et al. CRISPR interference can prevent natural transformation and virulence acquisition during in vivo bacterial infection. Cell Host Microbe. Aug. 16, 2012;12(2):177-86. doi: 10.1016/j.chom.2012.06.003.

Boehr, et al. The dynamic energy landscape of dihydrofolate reductase catalysis. Science. Sep. 15, 2006;313(5793):1638-42.

Brouns, et al. Small CRISPR RNAs guide antiviral defense in prokaryotes. Science. Aug. 15, 2008;321(5891):960-4. doi: 10.1126/science.1159689.

Browning, et al. Modulation of CRP-dependent transcription at the *Escherichia coli* acsP2 promoter by nucleoprotein complexes: anti-activation by the nucleoid proteins FIS and IHF. Mol Microbiol. Jan. 2004;51(1):241-54.

Campbell, et al. Structural mechanism for rifampicin inhibition of bacterial rna polymerase. Cell. Mar. 23, 2001;104(6):901-12.

Chang, et al. Structural systems biology evaluation of metabolic thermotolerance in *Escherichia coli*. Science. Jun. 7, 2013;340(6137)1 220-3. doi: 10.1126/science.1234012.

(56) References Cited

OTHER PUBLICATIONS

Chen, et al. Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.
Chiang, et al. Regulators of oxidative stress response genes in *Escherichia coli* and their functional conservation in bacteria. Arch Biochem Biophys. Sep. 15, 2012;525(2):161-9. doi: 10.1016/j.abb.2012.02.007. Epub Feb. 20, 2012.
Cong, et al. Multiplex genome engineering using CRISPR/Cas systems. Science. Feb. 15, 2013;339(6121):819-23. doi: 10.1126/science.1231143. Epub Jan. 3, 2013.
Co-pending U.S. Appl. No. 15/116,616, filed Aug. 4, 2016.
Co-pending U.S. Appl. No. 15/631,989, filed Jun. 23, 2017.
Co-pending U.S. Appl. No. 15/632,001, filed Jun. 23, 2017.
Costantino, et al. Enhanced levels of lambda Red-mediated recombinants in mismatch repair mutants. Proc Natl Acad Sci U S A. Dec. 23, 2003;100(26):15748-53. Epub Dec. 12, 2003.
Datta, et al. A set of recombineering plasmids for gram-negative bacteria. Gene. Sep. 1, 2006;379:109-15. Epub May 4, 2006.
Dicarlo, et al. Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
Dwyer, et al. Role of reactive oxygen species in antibiotic action and resistance. Curr Opin Microbiol. Oct. 2009;12(5):482-9. doi: 10.1016/j.mib.2009.06.018. Epub Jul. 31, 2009.
Ebright, et al. Consensus DNA site for the *Escherichia coli* catabolite gene activator protein (CAP): CAP exhibits a 450-fold higher affinity for the consensus DNA site than for the *E. coli* lac DNA site. Nucleic Acids Res. Dec. 25, 1989;17(24):10295-305.
Edgar. Search and clustering orders of magnitude faster than BLAST. Bioinformatics. Oct. 1, 2010;26(19):2460-1. doi: 10.1093/bioinformatics/btq461. Epub Aug. 12, 2010.
Eklund, et al. Altered target site specificity variants of the I-Ppol His-Cys box homing endonuclease. Nucleic Acids Res. 2007;35(17):5839-50. Epub Aug. 24, 2007.
European Search Report dated Jun. 26, 2017 for EP Application No. 15749644.9.
Farasat, et al. Efficient search, mapping, and optimization of multi-protein genetic systems in diverse bacteria. Mol Syst Biol. Jun. 21, 2014;10:731. doi: 10.15252/msb.20134955.
Findlay, et al. Saturation editing of genomic regions by multiplex homology-directed repair. Nature. Sep. 4, 2014;513(7516):120-3. doi: 10.1038/nature13695.
Firth, et al. GLUE-IT and PEDEL-AA: new programmes for analyzing protein diversity in randomized libraries. Nucleic Acids Res. Jul. 1, 2008;36(Web Server issue):W281-5. doi: 10.1093/nar/gkn226. Epub Apr. 28, 2008.
Fisher, et al. Enhancing tolerance to short-chain alcohols by engineering the *Escherichia coli* AcrB efflux pump to secrete the non-native substrate n-butanol. ACS Synth Biol. Jan. 17, 2014;3(1):30-40. doi: 10.1021/sb400065q. Epub Sep. 13, 2013.
Foo, et al. Directed evolution of an *E. coli* inner membrane transporter for improved efflux of biofuel molecules. Biotechnol Biofuels. May 21, 2013;6(1):81. doi: 10.1186/1754-6834-6-81.
Gao, et al. DNA-guided genome editing using the Natronobacterium gregoryi Argonaute. Nat Biotechnol. May 2, 2016. doi: 10.1038/nbt.3547.
Garst, et al., Genome-wide mapping of mutations at single-nucleotide resolution for protein, metabolic and genome engineering. Nature Biotechnology 35, 48-55 (2017) doi:10.1038/nbt.3718.
Garst, et al., Strategies for the multiplex mapping of genes to traits. Microbial Cell Factories 2013, 12:99.
Glebes, et al. Comparison of genome-wide selection strategies to identify furfural tolerance genes in *Escherichia coli*. Biotechnol Bioeng. Jan. 2015;112(1):129-40. doi: 10.1002/bit.25325. Epub Sep. 2, 2014.
Gutierrez-Rios, et al. Regulatory network of *Escherichia coli*: consistency between literature knowledge and microarray profiles. Genome Res. Nov. 2003;13(11):2435-43.

Hamady, et al. Error-correcting barcoded primers for pyrosequencing hundreds of samples in multiplex. Nat Methods. Mar. 2008;5(3):235-7. doi: 10.1038/nmeth.1184. Epub Feb. 10, 2008.
HHMI. The Fields lab homepage. Cloning Vectors. Available at http://depts.washington.edu/sfields/protocols/pOAD.html. Accessed on Jan. 3, 2017.
Ho, et al. Efficient Reassignment of a Frequent Serine Codon in Wild-Type *Escherichia coli*. ACS Synth Biol. Feb. 19, 2016;5(2):163-71. doi: 10.1021/acssynbio.5b00197. Epub Nov. 20, 2015.
Hung, et al. Crystal structure of AcrB complexed with linezolid at 3.5 Å resolution. J Struct Funct Genomics. Jun. 2013;14(2):71-5. doi: 10.1007/s10969-013-9154-x. Epub May 15, 2013.
Hwang, et al. Efficient genome editing in zebrafish using a CRISPR-Cas system. Nat Biotechnol. Mar. 2013;31(3):227-9. doi: 10.1038/nbt.2501. Epub Jan. 29, 2013.
Ibanez, et al. Mass spectrometry-based metabolomics of single yeast cells. Proc Natl Acad Sci U S A. May 28, 2013;110(22):8790-4. doi: 10.1073/pnas.1209302110. Epub May 13, 2013.
International search report and written opinion dated Jul. 28, 2015 for PCT/US2015/015476.
International search report and written opinion dated Nov. 5, 2012 for PCT/US2012/033799.
Isaacs, et al. Precise manipulation of chromosomes in vivo enables genome-wide codon replacement. Science. Jul. 15, 2011;333(6040):348-53. doi: 10.1126/science.1205822.
Iwakura, et al. Evolutional design of a hyperactive cysteine- and methionine-free mutant of *Escherichia coli* dihydrofolate reductase. J Biol Chem. May 12, 2006;281(19):13234-46. Epub Mar. 1, 2006.
Jiang, et al. Multigene editing in the *Escherichia coli* genome via the CRISPR-Cas9 system. Appl Environ Microbiol. Apr. 2015;81(7):2506-14. doi: 10.1128/AEM.04023-14. Epub Jan. 30, 2015.
Jiang, et al. RNA-guided editing of bacterial genomes using CRISPR-Cas systems. Nat Biotechnol. Mar. 2013;31(3):233-9. doi: 10.1038/nbt.2508. Epub Jan. 29, 2013.
Jinek, et al. A programmable dual-RNA-guided DNA endonuclease in adaptive bacterial immunity. Science. Aug. 17, 2012;337(6096):816-21. doi: 10.1126/science.1225829. Epub Jun. 28, 2012.
Kersten, et al. A mass spectrometry-guided genome mining approach for natural product peptidogenomics. Nat Chem Biol. Oct. 9, 2011;7(11):794-802. doi: 10.1038/nchembio.684.
Kim, et al. A guide to genome engineering with programmable nucleases. Nat Rev Genet. May 2014;15(5):321-34. doi: 10.1038/nrg3686. Epub Apr. 2, 2014.
Kim, et al. Hybrid restriction enzymes: zinc finger fusions to Fok I cleavage domain. Proc Natl Acad Sci U S A. Feb. 6, 1996;93(3):1156-60.
Kohanski, et al. A common mechanism of cellular death induced by bactericidal antibiotics. Cell. Sep. 7, 2007;130(5):797-810.
Kosuri, et al. Scalable gene synthesis by selective amplification of DNA pools from high-fidelity microchips. Nat Biotechnol. Dec. 2010;28(12):1295-9. doi: 10.1038/nbt.1716. Epub Nov. 28, 2010.
Kwon, et al. Crystal structure of the *Escherichia coli* Rob transcription factor in complex with DNA. Nat Struct Biol. May 2000;7(5):424-30.
Lajoie, et al. Genomically recoded organisms expand biological functions. Science. Oct. 18, 2013;342(6156):357-60. doi: 10.1126/science.1241459.
Li, et al. Identification of factors influencing strand bias in oligonucleotide-mediated recombination in *Escherichia coli*. Nucleic Acids Res. Nov. 15, 2003;31(22):6674-87.
Li, et al. Metabolic engineering of *Escherichia coli* using CRISPR-Cas9 meditated genome editing. Metab Eng. Sep. 2015;31:13-21. doi: 10.1016/j.ymben.2015.06.006. Epub Jun. 30, 2015.
Liu, et al. Efficient genome editing in filamentous fungus Trichoderma reesei using the CRISPR/Cas9 system. Cell Discovery. 2015; 1:15007. doi:10.1038/celldisc.2015.7.
Makarova et al. An updated evolutionary classification of CRISPR-Cas systems. Nat Rev Microbiol 13:722-736 (2015).

(56) References Cited

OTHER PUBLICATIONS

Makarova, et al. Evolution and classification of the CRISPR-Cas systems. Nat Rev Microbiol. Jun. 2011;9(6):467-77. doi: 10.1038/nrmicro2577. Epub May 9, 2011.

Mali, et al. RNA-guided human genome engineering via Cas9. Science. Feb. 15, 2013;339(6121):823-6. doi: 10.1126/science.1232033. Epub Jan. 3, 2013.

Maruyama, et al. Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Mills, et al. Cellulosic hydrolysate toxicity and tolerance mechanisms in *Escherichia coli*. Biotechnol Biofuels. Oct. 15, 2009;2:26. doi: 10.1186/1754-6834-2-26.

Molodtsov, et al. X-ray crystal structures of the *Escherichia coli* RNA polymerase in complex with benzoxazinorifamycins. J Med Chem. Jun. 13, 2013;56(11):4758-63. doi: 10.1021/jm4004889. Epub May 31, 2013.

Murakami, et al. Structural basis of transcription initiation: RNA polymerase holoenzyme at 4 A resolution. Science. May 17, 2002;296(5571):1280-4.

Nakashima, et al. Structural basis for the inhibition of bacterial multidrug exporters. Nature. Aug. 1, 2013;500(7460):102-6. doi: 10.1038/nature12300. Epub Jun. 30, 2013.

Nakashima, et al. Structures of the multidrug exporter AcrB reveal a proximal multisite drug-binding pocket. Nature. Nov. 27, 2011;480(7378):565-9. doi: 10.1038/nature10641.

NCBI. Basic Local Alignment Search Tool. Available at https://blast.ncbi.nlm.nih.gov/Blast.cgi. Accessed on Jan. 3, 2017.

Neylon, Cameron., Chemical and biochemical strategies for the randomization of protein encoding DNA sequences: library construction methods for directed evolution. Nucleic Acids Research, 2004, vol. 32, No. 4. 1448-1459.

Office Action dated Jun. 16, 2016 for U.S. Appl. No. 14/110,072.
Office Action dated Jun. 21, 2017 for U.S. Appl. No. 14/110,072.
Office Action dated Dec. 9, 2016 for U.S. Appl. No. 14/110,072.

Oh, et al. CRISPR-Cas9-assisted recombineering in Lactobacillus reuteri. Nucleic Acids Res. 2014;42(17):e131. doi: 10.1093/nar/gku623. Epub Jul. 29, 2014.

Pines, et al. Codon compression algorithms for saturation mutagenesis. ACS Synth Biol. May 15, 2015;4(5):604-14. doi: 10.1021/sb500282v. Epub Oct. 30, 2014.

Prior, et al. Broad-host-range vectors for protein expression across gram negative hosts. Biotechnol Bioeng. Jun. 1, 2010;106(2):326-32. doi: 10.1002/bit.22695.

Qi, et al. Repurposing CRISPR as an RNA-guided platform for sequence-specific control of gene expression. Cell. Feb. 28, 2013;152(5):1173-83. doi: 10.1016/j.cell.2013.02.022.

Raman, et al. Evolution-guided optimization of biosynthetic pathways. Proc Natl Acad Sci U S A. Dec. 16, 2014;111(50):17803-8. doi: 10.1073/pnas.1409523111. Epub Dec. 1, 2014.

Reynolds, et al. Quantifying Impact of Chromosome Copy Number on Recombination in *Escherichia coli*. ACS Synth Biol. Jul. 17, 2015;4(7):776-80. doi: 10.1021/sb500338g. Epub Mar. 19, 2015.

Rhee, et al. A novel DNA-binding motif in MarA: the first structure for an AraC family transcriptional activator. Proc Natl Acad Sci U S A. Sep. 1, 1998;95(18)10413-8.

Rice, et al. Crystal structure of an IHF-DNA complex: a protein-induced DNA U-turn. Cell. Dec. 27, 1996;87(7):1295-306.

Rodriguez-Verdugo, et al. Evolution of *Escherichia coli* rifampicin resistance in an antibiotic-free environment during thermal stress. BMC Evol Biol. Feb. 22, 2013;13:50. doi: 10.1186/1471-2148-13-50.

Ronda, et al. CRMAGE: CRISPR Optimized MAGE Recombineering. Sci Rep. Jan. 22, 2016;6:19452. doi: 10.1038/srep19452.

Ross, et al. A third recognition element in bacterial promoters: DNA binding by the alpha subunit of RNA polymerase. Science. Nov. 26, 1993;262(5138):1407-13.

Sandoval, et al. Strategy for directing combinatorial genome engineering in *Escherichia coli*. Proc Natl Acad Sci U S A. Jun. 26, 2012;109(26):10540-5. doi: 10.1073/pnas.1206299109. Epub Jun. 11, 2012.

Sawitzke, et al. Probing cellular processes with oligo-mediated recombination and using the knowledge gained to optimize recombineering. J Mol Biol. Mar. 18, 2011;407(1):45-59. doi: 10.1016/j.jmb.2011.01.030. Epub Jan. 19, 2011.

Semenova, et al. Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.

Shalem, et al. Genome-scale CRISPR-Cas9 knockout screening in human cells. Science. Jan. 3, 2014;343(6166):84-7. doi: 10.1126/science.1247005. Epub Dec. 12, 2013.

Shendure. Life after genetics. Genome Med. Oct. 29, 2014;6(10):86. doi: 10.1186/s13073-014-0086-2. eCollection 2014.

Shmakov et al. Discovery and Functional Characterization of Diverse Class 2 CRISPR-Cas Systems. Mol Cell 60(3):385-397 (2015).

Smanski, et al. Functional optimization of gene clusters by combinatorial design and assembly. Nat Biotechnol. Dec. 2014;32(12):1241-9. doi: 10.1038/nbt.3063. Epub Nov. 24, 2014.

Stearns, et al., Manipulating yeast genome using plasmid vectors. Methods in Enzymology. 1990, 185:280-297.

Steinmetz, et al. Maximizing the potential of functional genomics. Nat Rev Genet. Mar. 2004;5(3):190-201.

Stoebel, et al. Compensatory evolution of gene regulation in response to stress by *Escherichia coli* lacking RpoS. PLoS Genet. Oct. 2009;5(10):e1000671. doi: 10.1371/journal.pgen.1000671. Epub Oct. 2, 2009.

Swarts, et al. Argonaute of the archaeon *Pyrococcus furiosus* is a DNA-guided nuclease that targets cognate DNA. Nucleic Acids Res. May 26, 2015;43(10):5120-9. doi: 10.1093/nar/gkv415. Epub Apr. 29, 2015.

Swarts, et al. DNA-guided DNA interference by a prokaryotic Argonaute. Nature. Mar. 13, 2014;507(7491):258-61. doi: 10.1038/nature12971. Epub Feb. 16, 2014.

Tenaillon, et al. The molecular diversity of adaptive convergence. Science. Jan. 27, 2012;335(6067):457-61. doi: 10.1126/science.1212986.

Toprak, et al. Evolutionary paths to antibiotic resistance under dynamically sustained drug selection. Nat Genet. Dec. 18, 2011;44(1):101-5. doi: 10.1038/ng.1034.

Waaijers, et al. CRISPR/Cas9-targeted mutagenesis in Caenorhabditis elegans. Genetics. Nov. 2013;195(3):1187-91. doi: 10.1534/genetics.113.156299. Epub Aug. 26, 2013.

Wang, et al. Engineering furfural tolerance in *Escherichia coli* improves the fermentation of lignocellulosic sugars into renewable chemicals. Proc Natl Acad Sci U S A. Mar. 5, 2013;110(10):4021-6. doi: 10.1073/pnas.1217958110. Epub Feb. 19, 2013.

Wang, et al. Genome-scale promoter engineering by coselection MAGE. Nat Methods. Jun. 2012;9(6):591-3. doi: 10.1038/nmeth.1971. Epub Apr. 8, 2012.

Wang, et al. Multiplexed in vivo His-tagging of enzyme pathways for in vitro single-pot multienzyme catalysis. ACS Synth Biol. Feb. 17, 2012;1(2):43-52.

Wang, et al. One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.

Wang, et al. Programming cells by multiplex genome engineering and accelerated evolution. Nature. Aug. 13, 2009;460(7257):894-8. doi: 10.1038/nature08187. Epub Jul. 26, 2009.

Warner, et al. Rapid profiling of a microbial genome using mixtures of barcoded oligonucleotides. Nat Biotechnol. Aug. 2010;28(8):856-62. doi: 10.1038/nbt.1653. Epub Jul. 18, 2010.

Watson, et al. Directed evolution of trimethoprim resistance in *Escherichia coli*. FEBS J. May 2007;274(10):2661-71. Epub Apr. 19, 2007.

Wetmore, et al. Rapid quantification of mutant fitness in diverse bacteria by sequencing randomly bar-coded transposons. MBio. May 12, 2015;6(3):e00306-15. doi: 10.1128/mBio.00306-15.

(56) References Cited

OTHER PUBLICATIONS

White, et al. Role of the acrAB locus in organic solvent tolerance mediated by expression of marA, soxS, or robA in *Escherichia coli*. J Bacteriol. Oct. 1997;179(19):6122-6.

"Withers, et al.Identification of isopentenol biosynthetic genes from Bacillus subtilis by a screening method based on isoprenoid precursor toxicity. Appl Environ Microbiol. Oct. 2007;73(19):6277-83. Epub Aug. 10, 2007.".

Wolfe. The acetate switch. Microbiol Mol Biol Rev. Mar. 2005;69(1):12-50.

Zeitoun, et al. Multiplexed tracking of combinatorial genomic mutations in engineered cell populations. Nat Biotechnol. Jun. 2015;33(6):631-7. doi: 10.1038/nbt.3177. Epub Mar. 23, 2015.

Zetsche, et al. Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.

Zhang, et al., Efficient editing of malaria parasite genome using the CRISPR/Cas9 system. mBio. Jul. 2014; vol. 5 Art. e01414-14.

Zhao, et al. Activity and specificity of the bacterial PD-(D/E)XK homing endonuclease I-Ssp68031. J Mol Biol. Feb. 6, 2009;385(5):1498-510. doi: 10.1016/j.jmb.2008.10.096. Epub Nov. 12, 2008.

Zheng, et al. Metabolic engineering of *Escherichia coli* for high-specificity production of isoprenol and prenol as next generation of biofuels. Biotechnol Biofuels. Apr. 24, 2013;6:57. doi: 10.1186/1754-6834-6-57. eCollection 2013.

Co-pending U.S. Appl. No. 15/630,909, filed Jun. 22, 2017.

Examination Report dated Jun. 27, 2017 for GB Application No. 1615434.6.

"Dickinson et al. Engineering the Caenorhabditis elegans Genome Using Cas9-Triggered Homologous Recombination; Nat Methods. Oct. 2013; 10(10): 1028-1034; doi: 10.1038/nmeth.2641".

International Search Report dated Nov. 29, 2017 for International Patent Application No. PCT/US2017/039146.

Office Action dated Nov. 8, 2017 for U.S. Appl. No. 15/630,909.

* cited by examiner

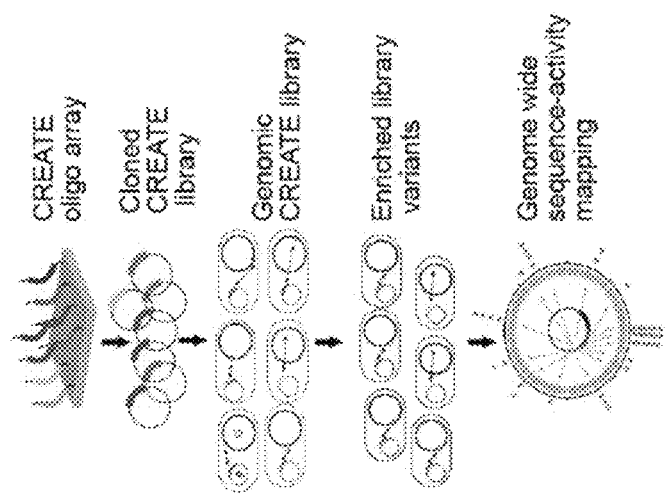
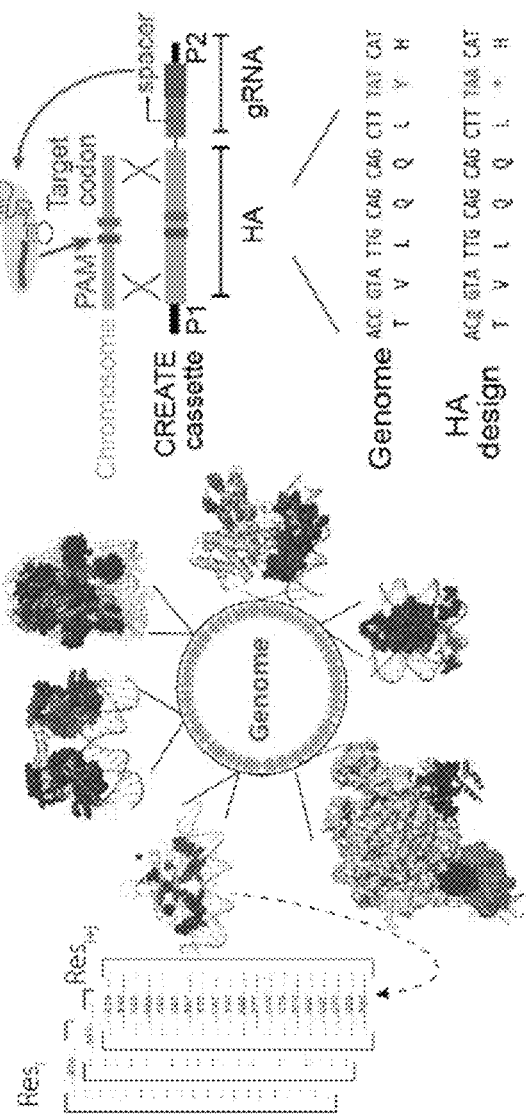

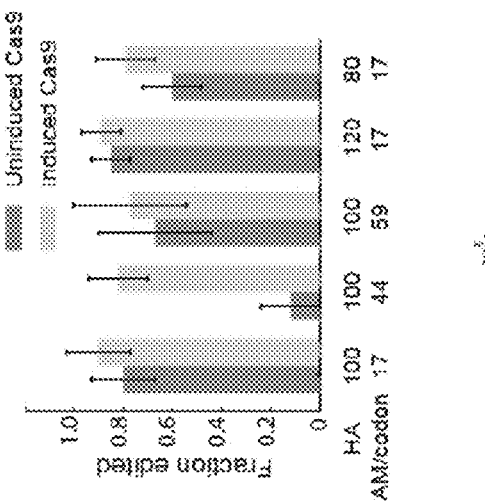
Figure 2A
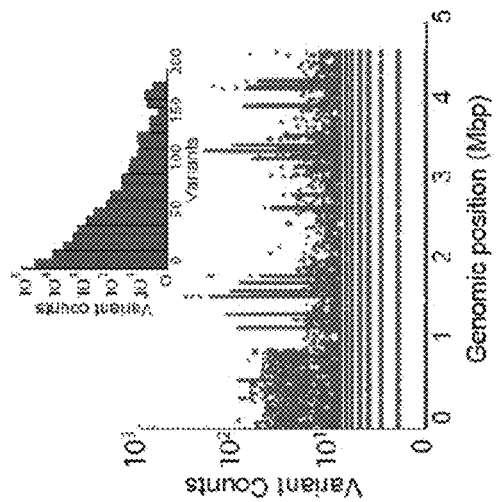
Figure 2B
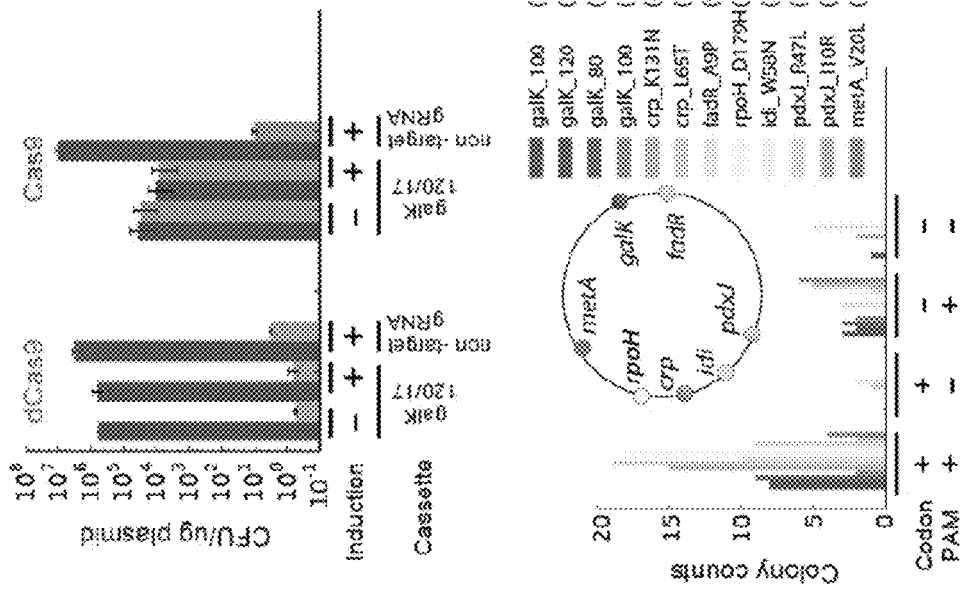
Figure 2C
Figure 2D

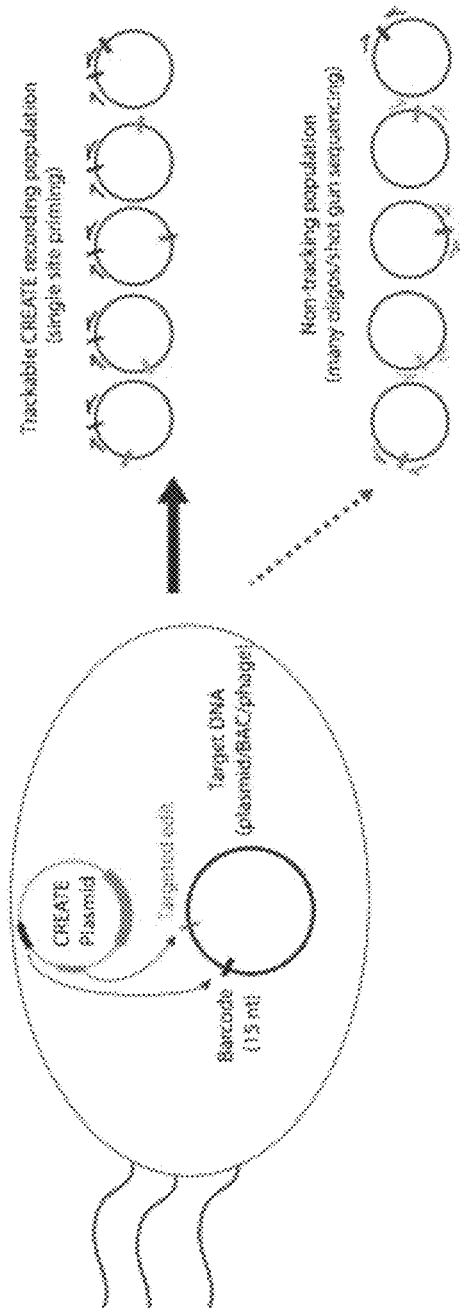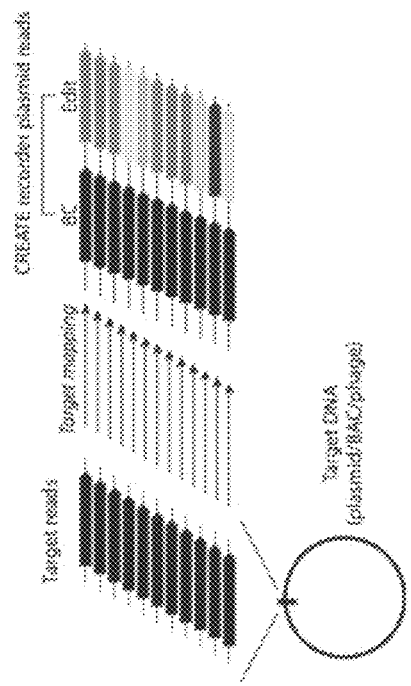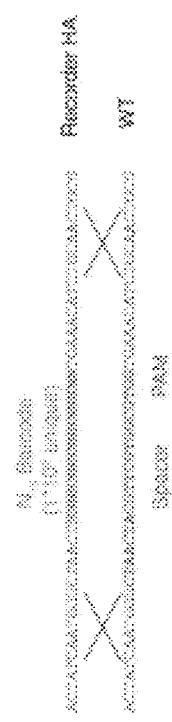
Figure 3A
Figure 3B
Figure 3C

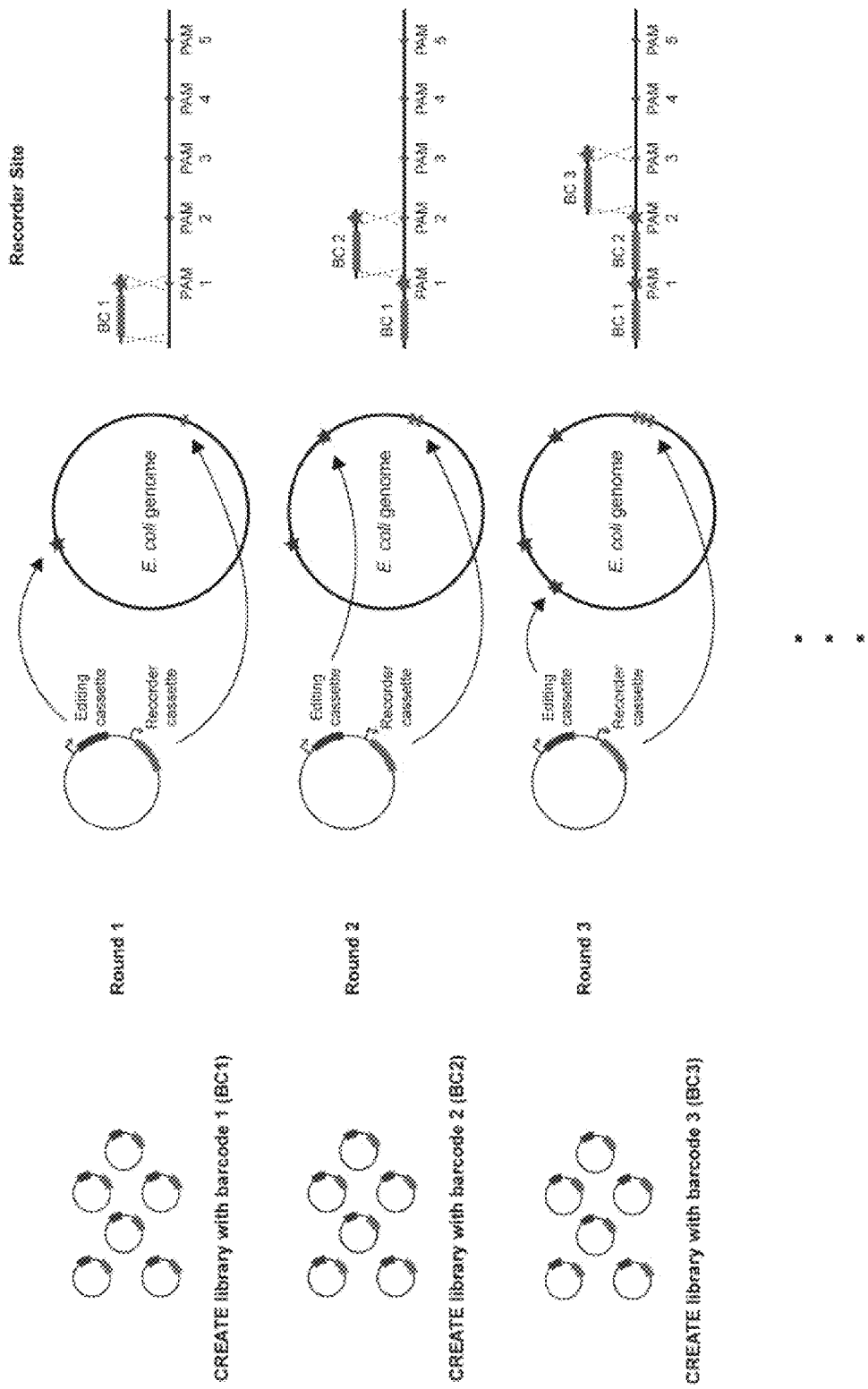

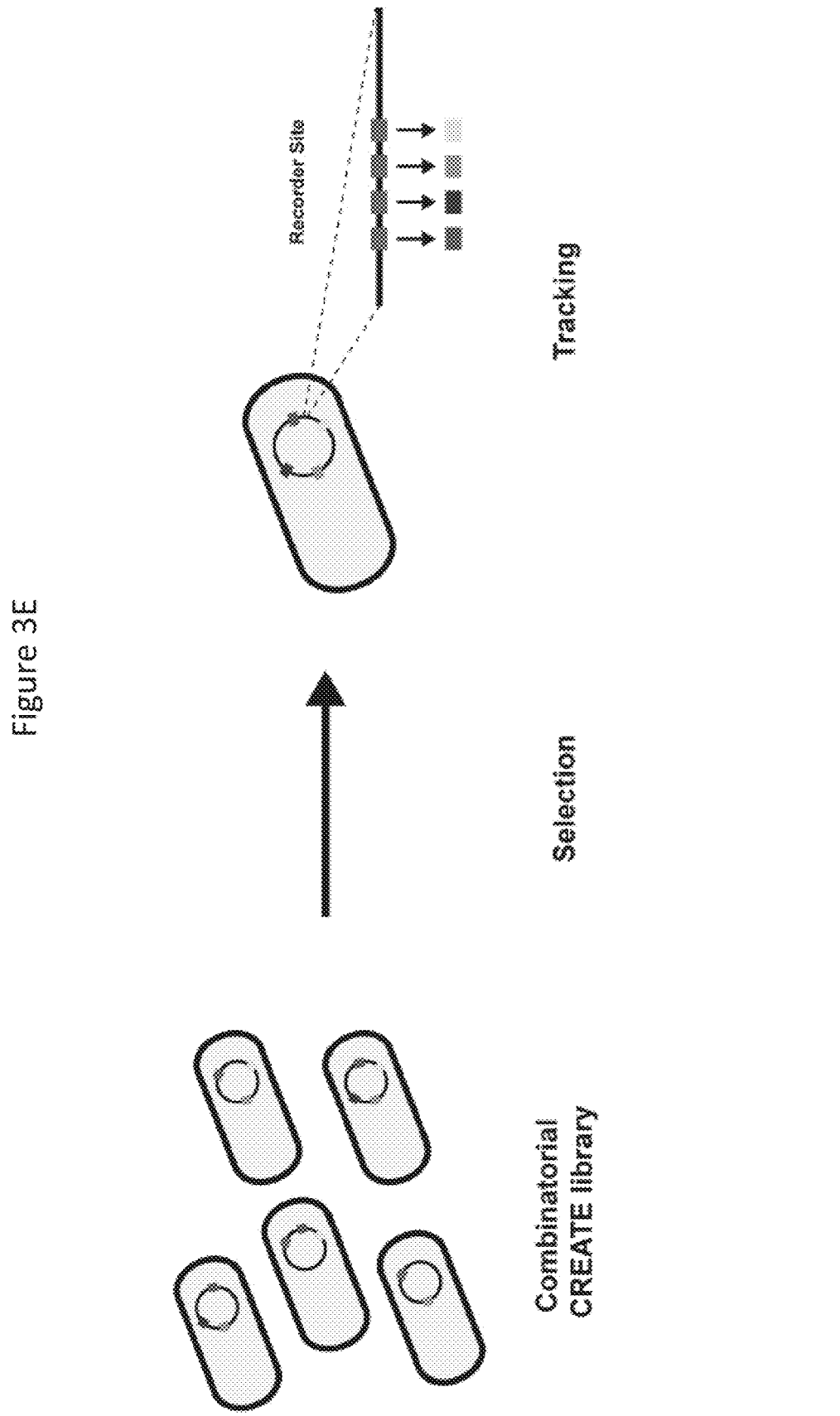

Figure 7B

| | Kan | Carb | Tet | Trimeth |
|---|---|---|---|---|
| MG1655 (pCas9 + reCREATE-1) | + | + |  |  |

Transform with reCREATE plasmid 2 → Select on Kan/Tet

| | Kan | Carb | Tet | Trimeth |
|---|---|---|---|---|
| MG1655 (pCas9 + reCREATE-2) | + + | +  |  + |  |

Transform with reCREATE plasmid 3 → Select on Kan/Trimeth

| | Kan | Carb | Tet | Trimeth |
|---|---|---|---|---|
| MG1655 (pCas9 + reCREATE-3) | + + |  | +  |  + |

Transform with reCREATE plasmid 1 → Select on Kan/Carb

| | Kan | Carb | Tet | Trimeth |
|---|---|---|---|---|
| MG1655 (pCas9 + reCREATE-1) | + + |  + |  | +  |

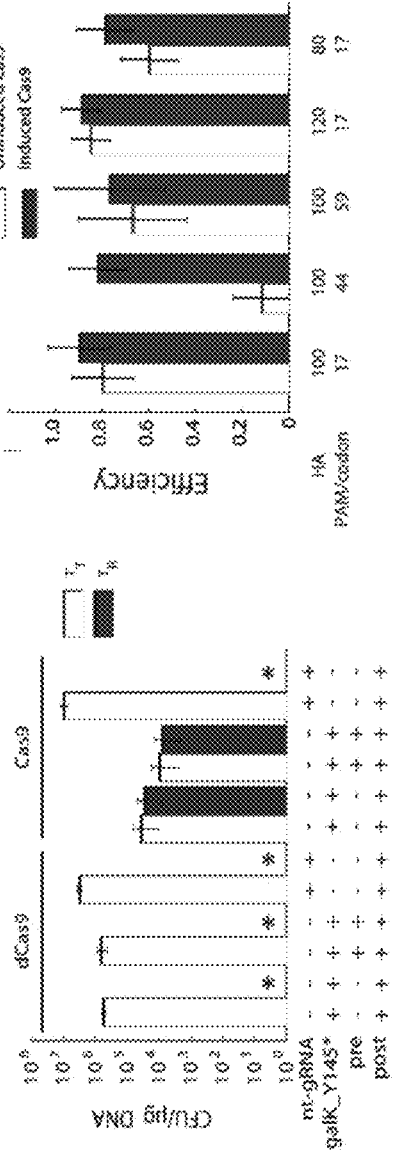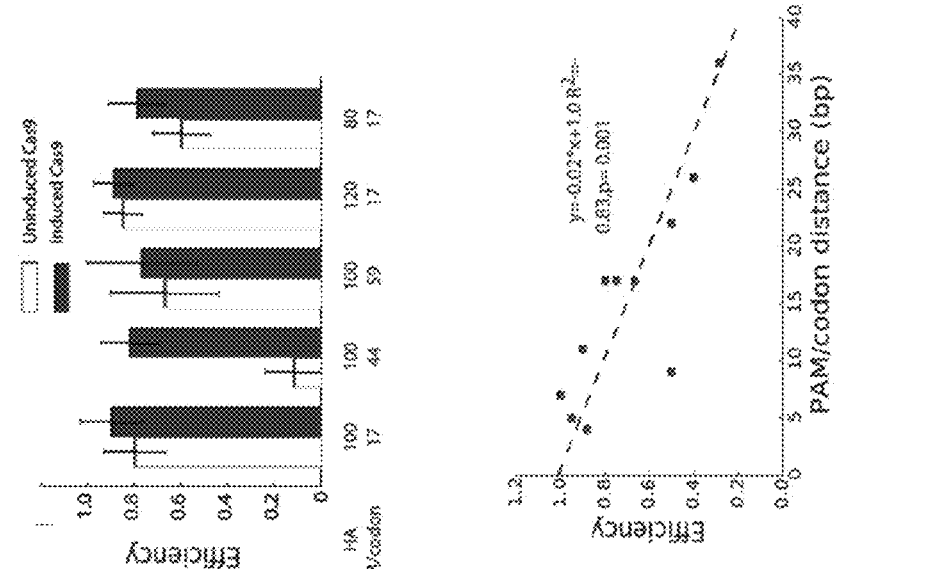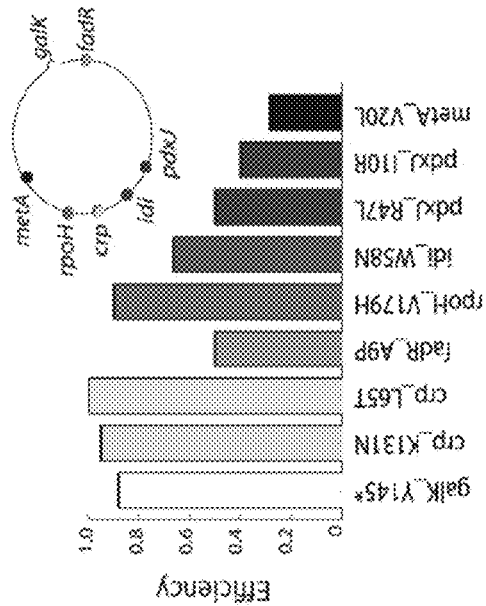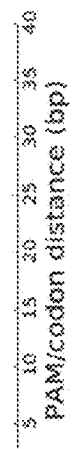
Figure 9A
Figure 9B
Figure 9C
Figure 9D

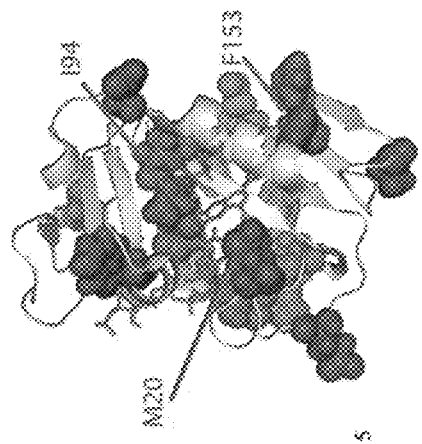
Figure 10C
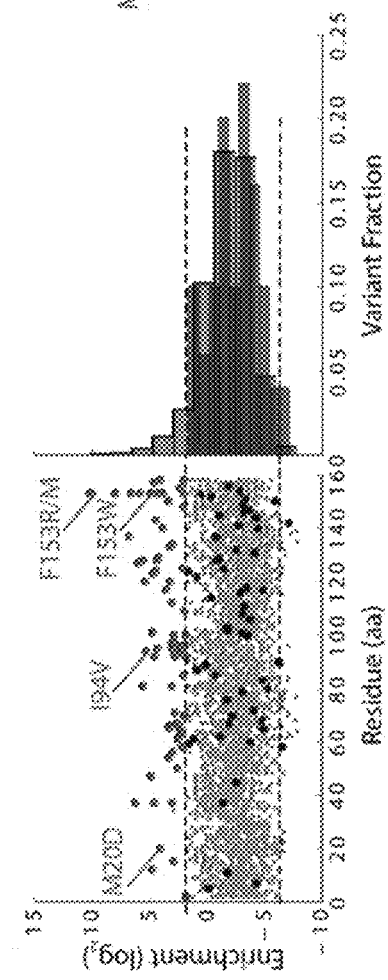
Figure 10B
Figure 10A
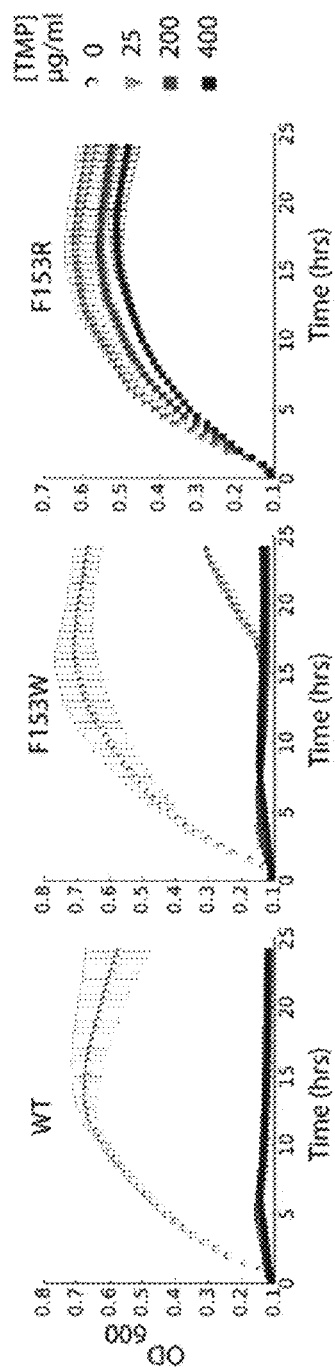
Figure 10F
Figure 10E
Figure 10D

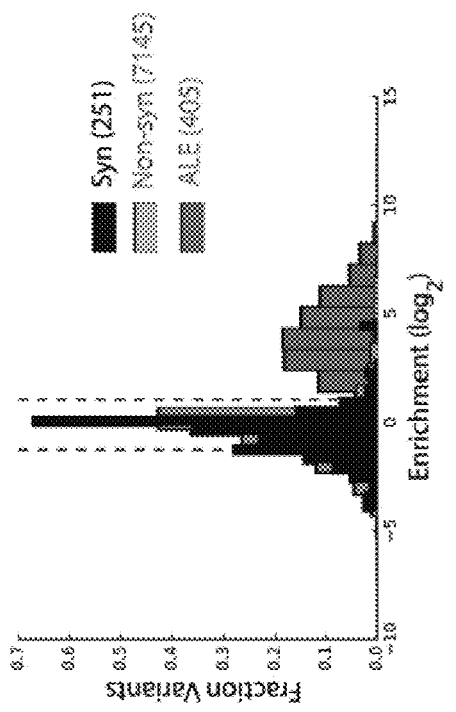
Figure 11A
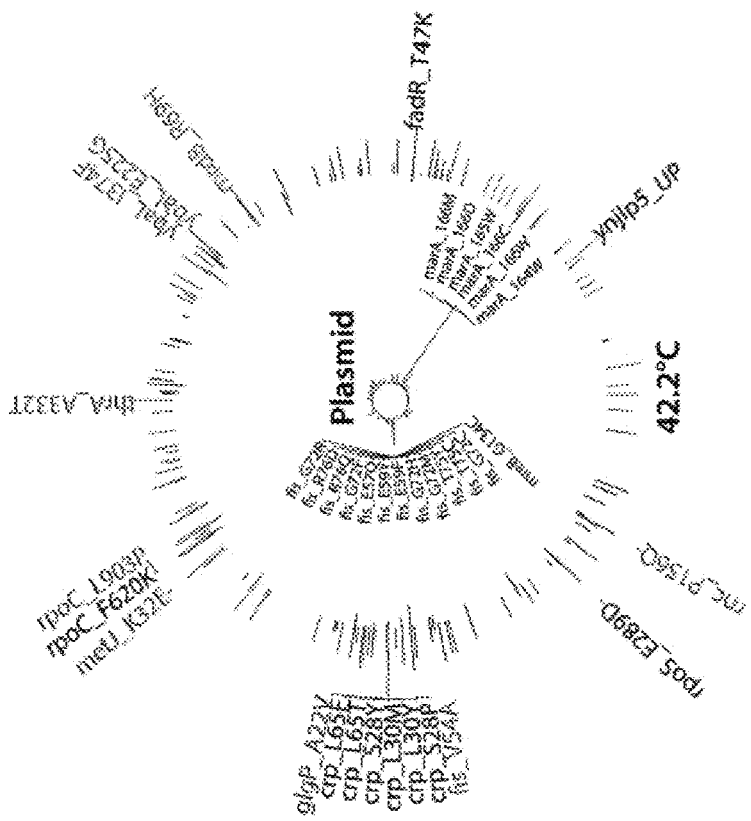
Figure 11B
Figure 11C

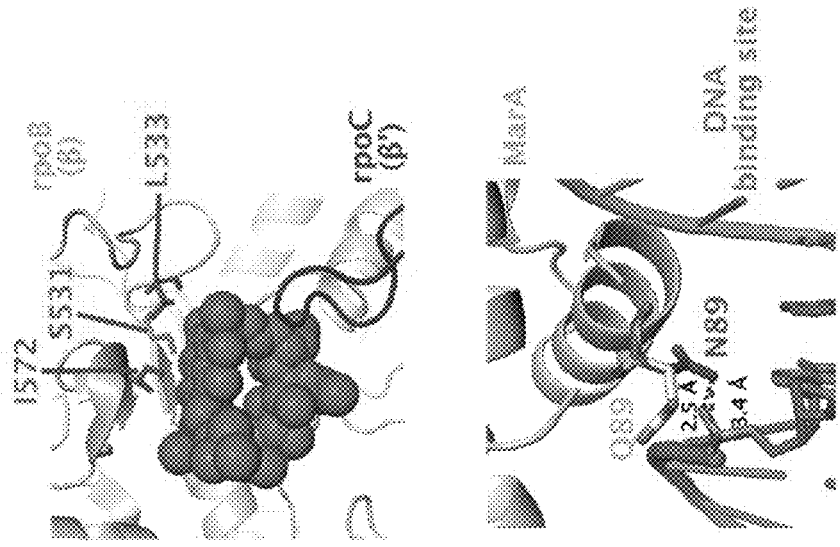
Figure 12B
Figure 12C
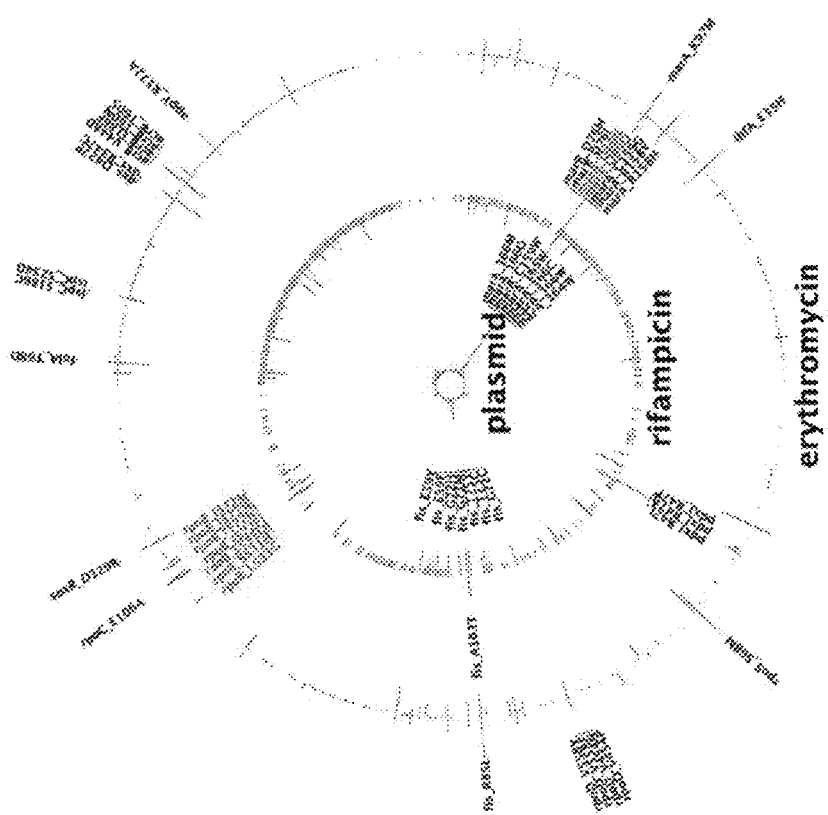
Figure 12A

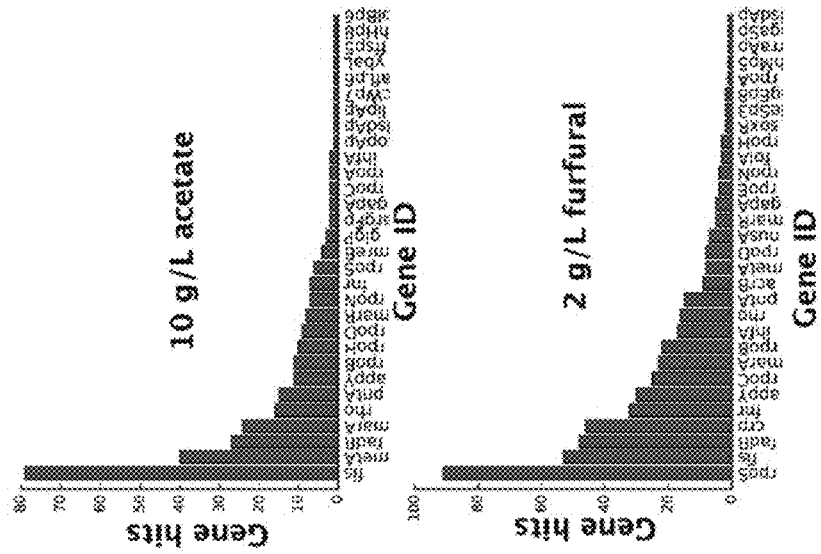
Figure 12E
Figure 12F
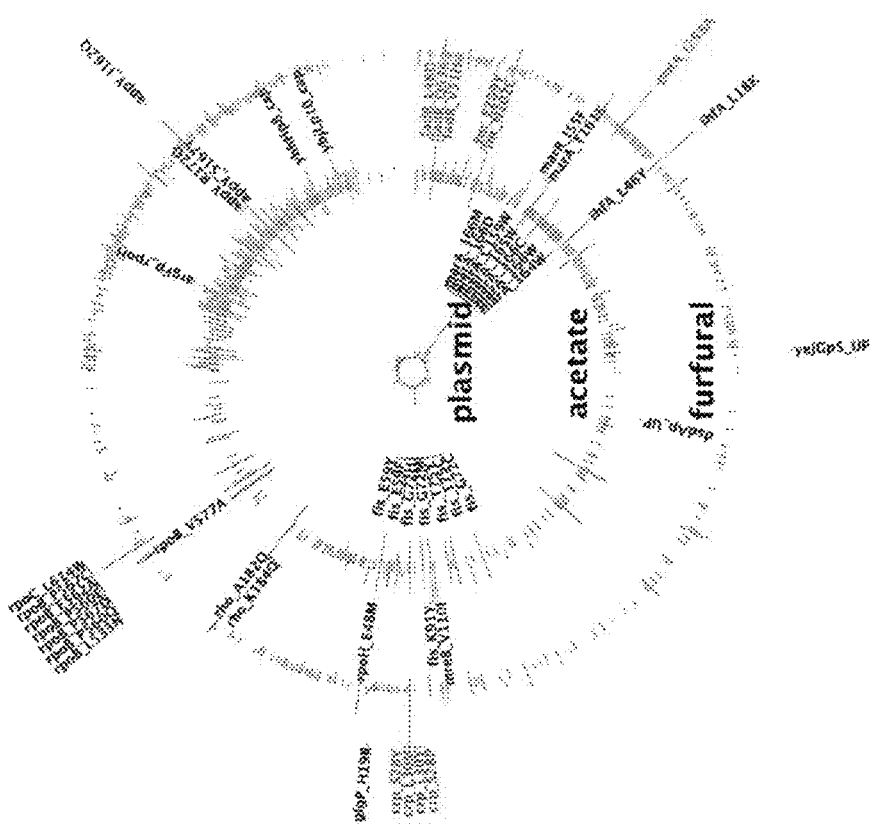
Figure 12D

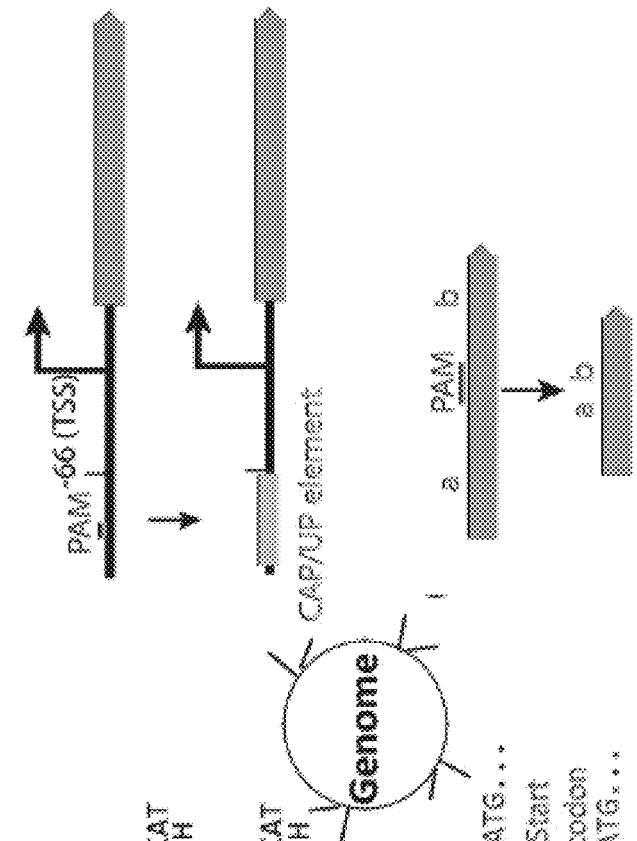
Figure 13B
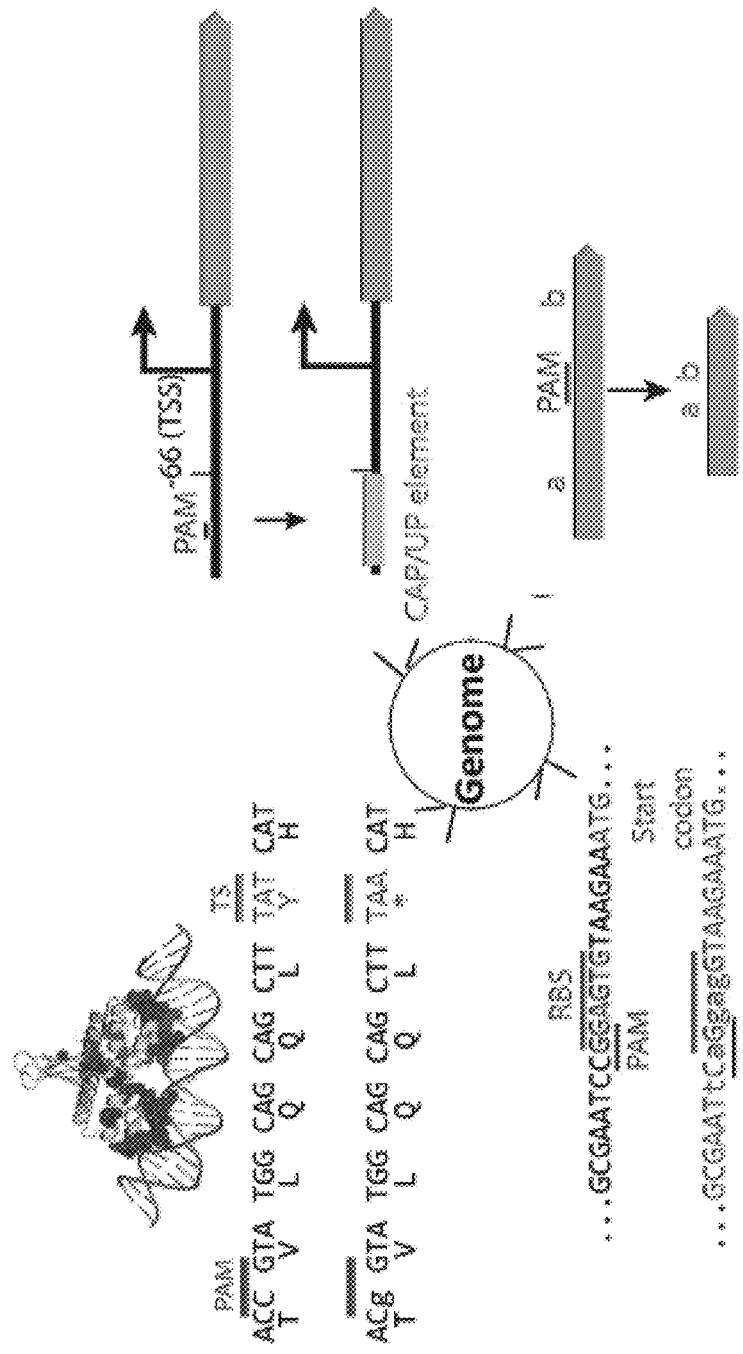
Figure 13A
Figure 13C
Figure 13D

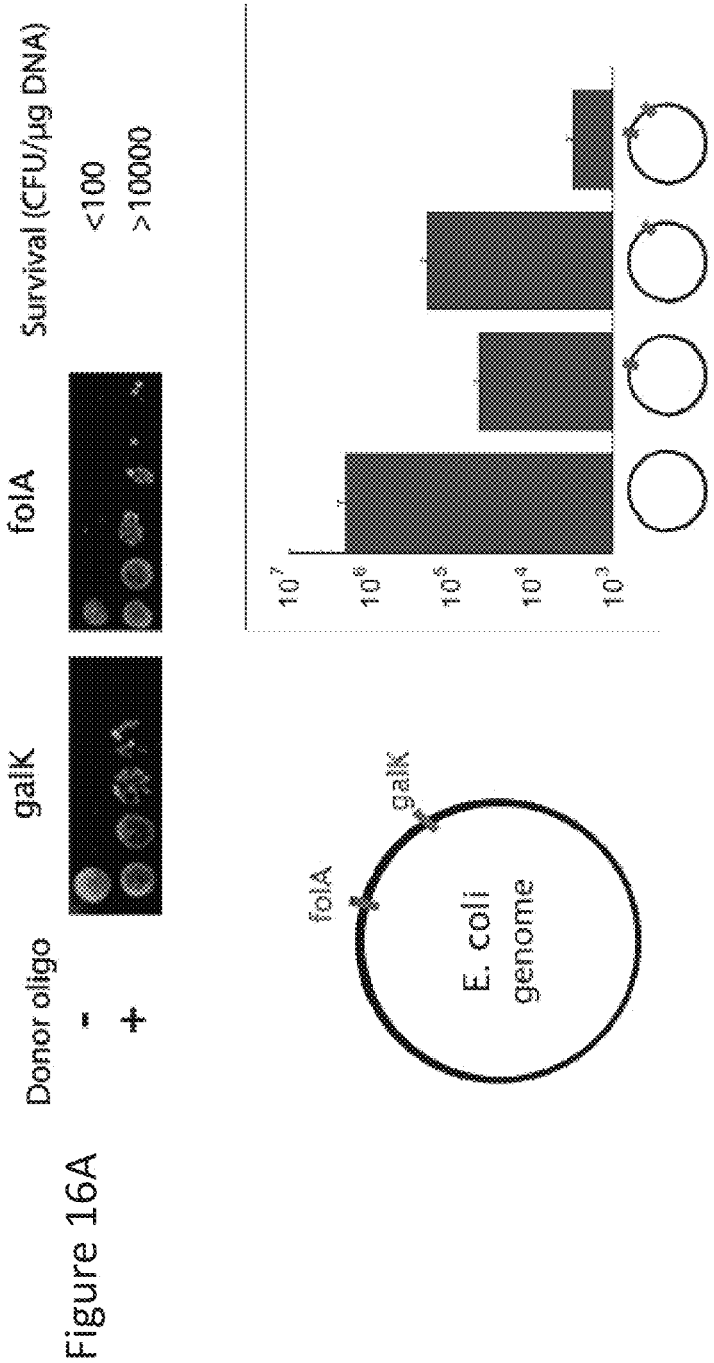

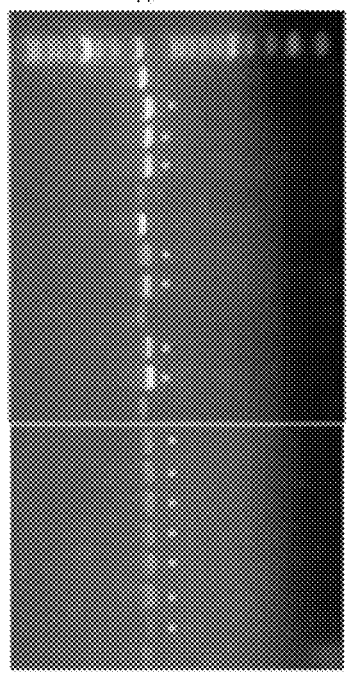
Figure 17B
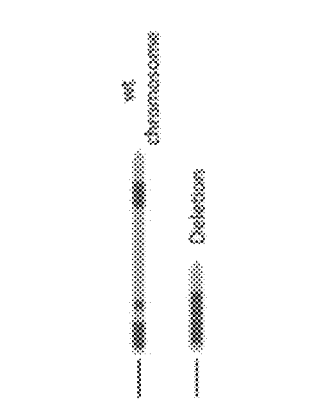
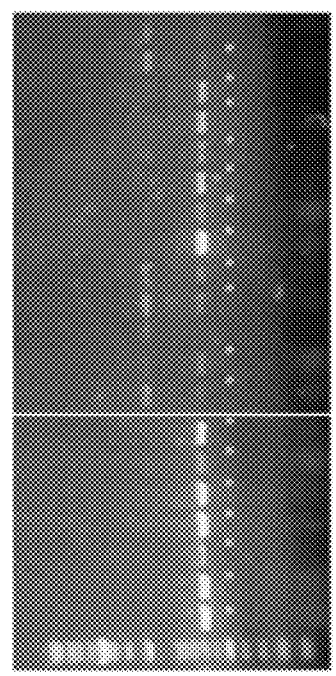
Figure 17D
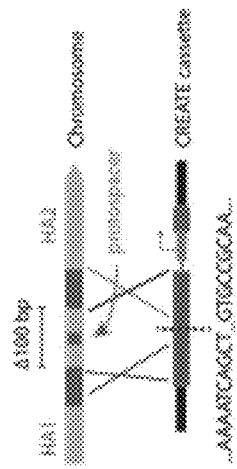
Figure 17A
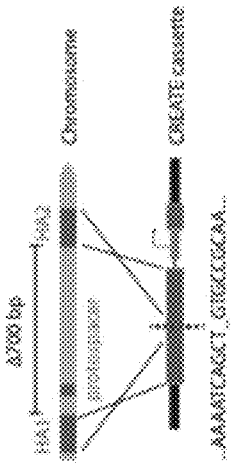
Figure 17C

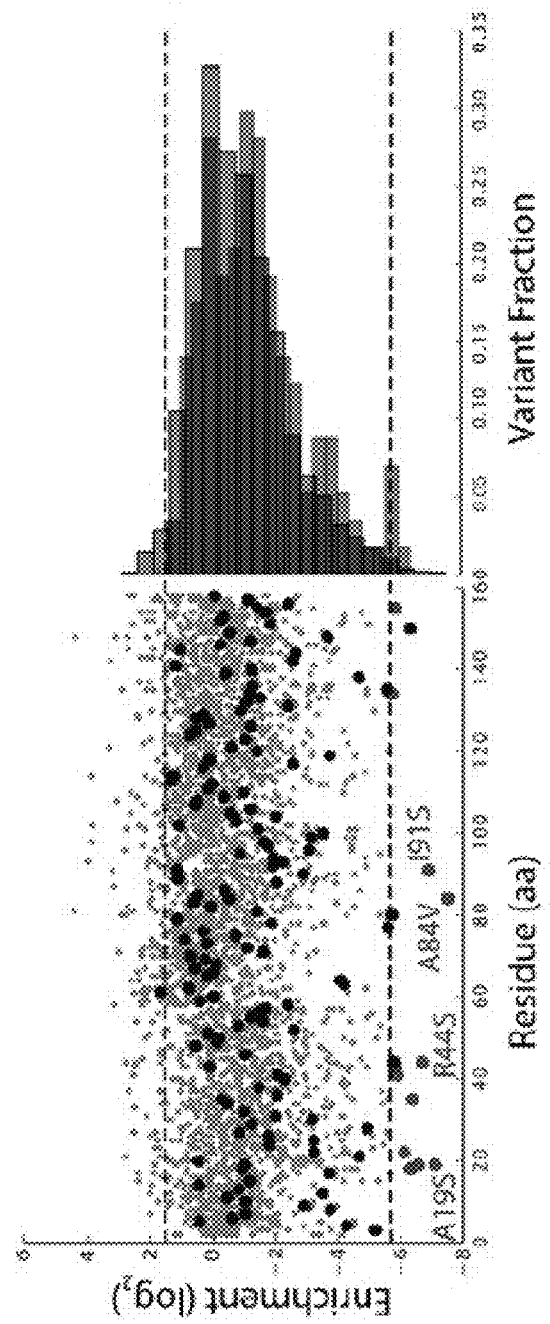
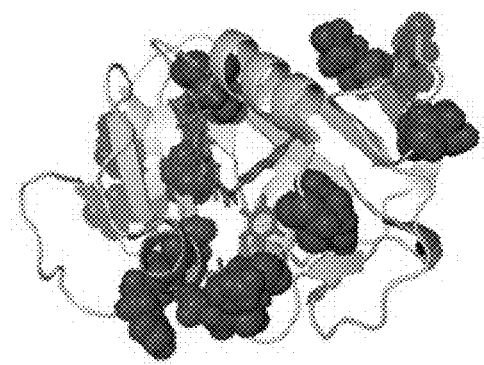
Figure 22A Figure 22B Figure 22C

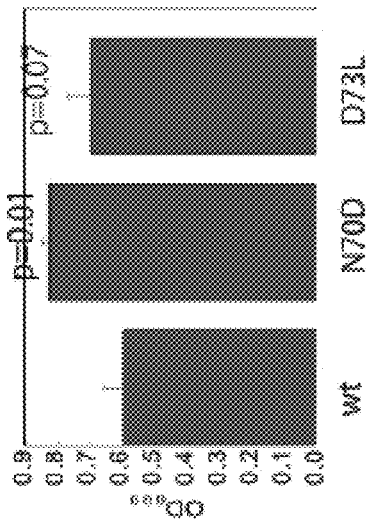
Figure 23D
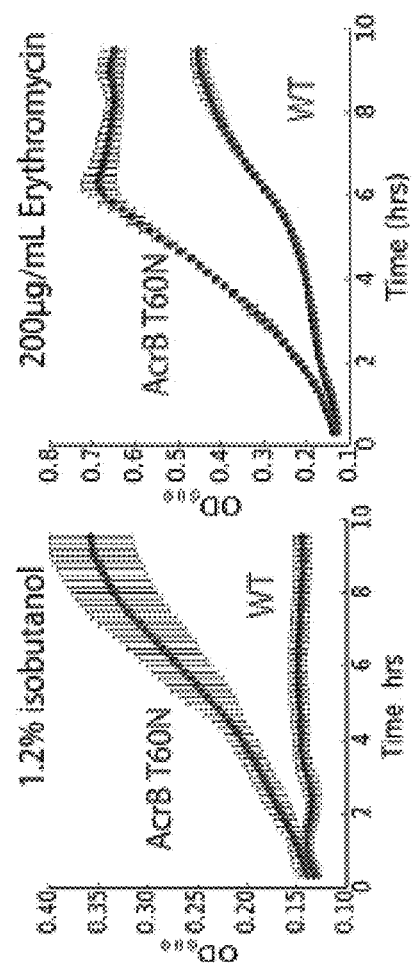
Figure 23F
Figure 23E

Figure 27C

| Colony # | Vector | Edited? | Barcoded? |
|---|---|---|---|
| 1 | gR1 | * | * |
| 2 | gR1 | * | * |
| 3 | gR1 | * | * |
| 4 | gR1 | * | * |
| 5 | gR1 | * | * |
| 6 | gR1 | * | * |
| 7 | gR1 | * | * |
| 8 | gR1 | * | * |
| 9 | gR1 | * | * |
| 10 | gR1 | * | * |
| 11 | gR1 | * | * |
| 12 | gR1 | * | * |
| 13 | gR1 | * | * |
| 14 | gR1 | * | * |
| 15 | gR1 | * | * |
| 16 | gR1 | * | * |
| 17 | gR1 | * | * |
| 18 | gR1 | * | * |
| 19 | gR1 | * | * |
| 20 | gR1 | * | * |
| 21 | gR1 | * | * |
| 22 | gR1 | * | * |
| 23 | gR1 | * | * |
| 24 | gR1 | * | * |
| 25 | gR1 | * | * |
| 26 | gR1 | * | * |
| 27 | gR1 | * | * |
| 28 | gR1 | * | * |
| 29 | gR1 | * | * |
| 30 | gR1 | * | * |

| Colony # | Vector | Edited? | Barcoded? |
|---|---|---|---|
| 1 | gR2 | * | * |
| 2 | gR2 | * | * |
| 3 | gR2 | * | * |
| 4 | gR2 | * | * |
| 5 | gR2 | * | * |
| 6 | gR2 | * | * |
| 7 | gR2 | * | * |
| 8 | gR2 | * | * |
| 9 | gR2 | * | * |
| 10 | gR2 | * | * |
| 11 | gR2 | * | * |
| 12 | gR2 | * | * |
| 13 | gR2 | * | * |
| 14 | gR2 | * | * |
| 15 | gR2 | * | * |
| 16 | gR2 | * | * |
| 17 | gR2 | * | * |
| 18 | gR2 | * | * |
| 19 | gR2 | * | * |
| 20 | gR2 | * | * |
| 21 | gR2 | * | * |
| 22 | gR2 | * | * |
| 23 | gR2 | * | * |
| 24 | gR2 | * | * |
| 25 | gR2 | * | * |
| 26 | gR2 | * | * |
| 27 | gR2 | * | * |
| 28 | gR2 | * | * |
| 29 | gR2 | * | * |
| 30 | gR2 | * | * |

| Colony # | Vector | Edited? | Barcoded? |
|---|---|---|---|
| 1 | gR3 | * | * |
| 2 | gR3 | * | * |
| 3 | gR3 | * | * |
| 4 | gR3 | * | * |
| 5 | gR3 | * | * |
| 6 | gR3 | * | * |
| 7 | gR3 | * | * |
| 8 | gR3 | * | * |
| 9 | gR3 | * | * |
| 10 | gR3 | * | * |
| 11 | gR3 | * | * |
| 12 | gR3 | * | * |
| 13 | gR3 | * | * |
| 14 | gR3 | * | * |
| 15 | gR3 | * | * |
| 16 | gR3 | * | * |
| 17 | gR3 | * | * |
| 18 | gR3 | * | * |
| 19 | gR3 | * | * |
| 20 | gR3 | * | * |
| 21 | gR3 | * | * |
| 22 | gR3 | * | * |
| 23 | gR3 | * | * |
| 24 | gR3 | * | * |
| 25 | gR3 |  | * |
| 26 | gR3 | * | * |
| 27 | gR3 | * | * |
| 28 | gR3 | * | * |
| 29 | gR3 | * | * |
| 30 | gR3 | * | * |

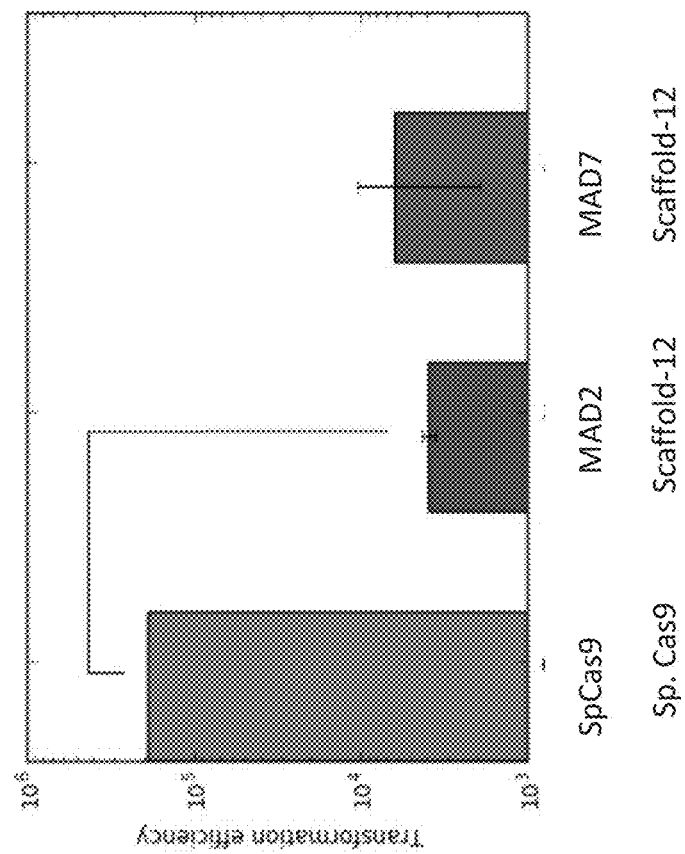
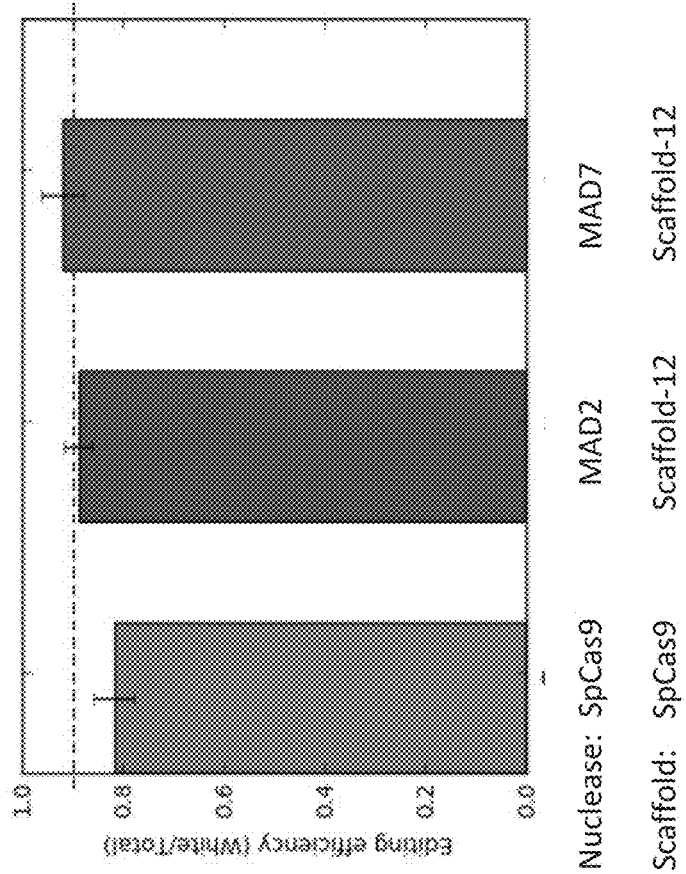
Figure 31A
Figure 31B

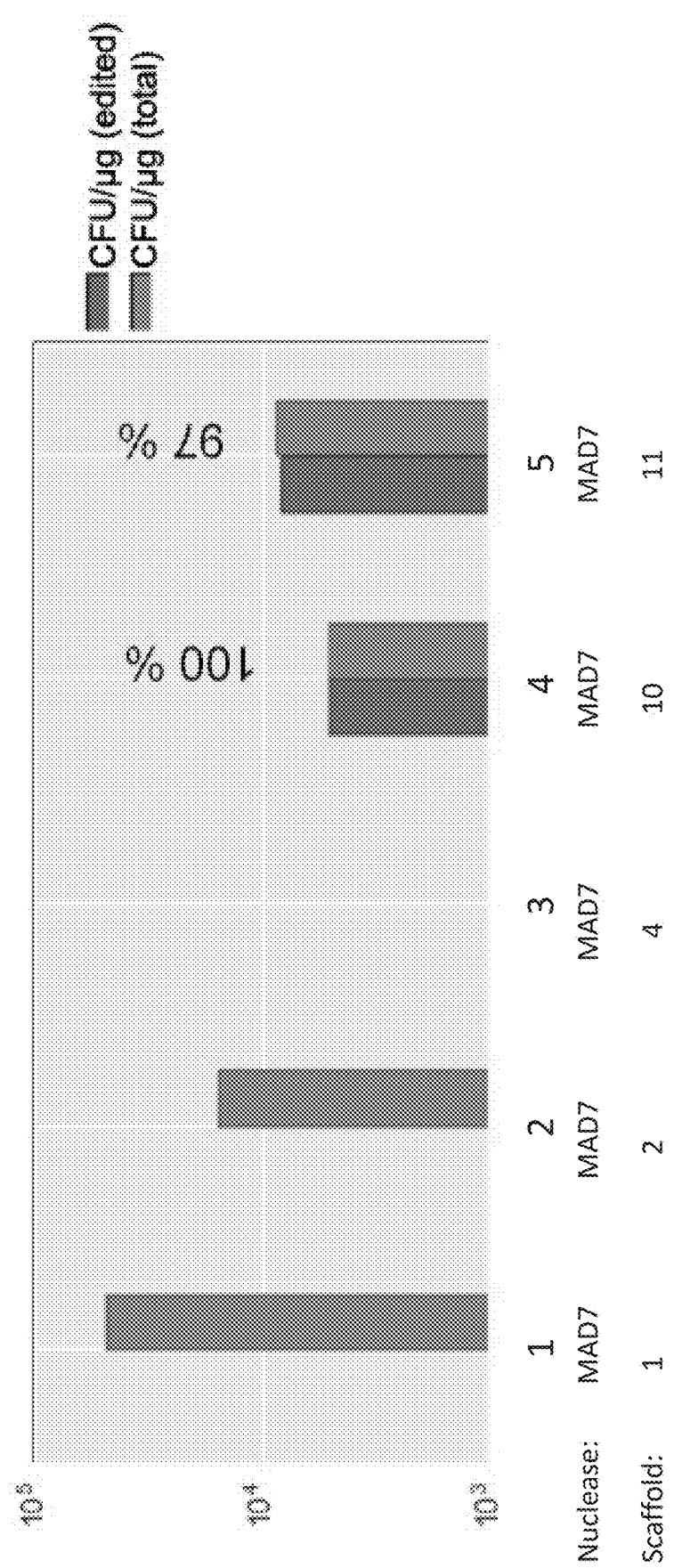

METHODS FOR GENERATING BARCODED COMBINATORIAL LIBRARIES

CROSS-REFERENCE

The present application claims priority to U.S. Provisional Application Ser. No. 62/354,516, filed Jun. 24, 2016; U.S. Provisional Application Ser. No. 62/367,386, filed Jul. 27, 2016; and U.S. Provisional Application Ser. No. 62/483,930, filed Apr. 10, 2017, the contents of each being hereby incorporated by reference in their entirety.

STATEMENT AS TO FEDERALLY SPONSORED RESEARCH

This disclosure was made with the support of the United States government under Contract number DE-SC0008812 by the Department of Energy.

SEQUENCE LISTING

The instant application contains a Sequence Listing which has been submitted electronically in ASCII format and is hereby incorporated by reference in its entirety. Said ASCII copy, created on Jul. 14, 2017, is named 49022-705_201_SL.txt and is 810,578 bytes in size. This application contains a sequence list in Table 5.

BACKGROUND OF THE DISCLOSURE

Understanding the relationship between a protein's amino acid structure and its overall function continues to be of great practical, clinical, and scientific significance for biologists and engineers. Directed evolution can be a powerful engineering and discovery tool, but the random and often combinatorial nature of mutations makes their individual impacts difficult to quantify and thus challenges further engineering. More systematic analysis of contributions of individual residues or saturation mutagenesis remains labor- and time-intensive for entire proteins and simply is not possible on reasonable timescales for editing of multiple proteins in parallel, such as metabolic pathways or multi-protein complexes, using standard methods.

SUMMARY OF THE DISCLOSURE

Disclosed herein are compositions comprising: i) a first donor nucleic acid comprising: a) a modified first target nucleic acid sequence; b) a first protospacer adjacent motif (PAM) mutation; and c) a first guide nucleic acid sequence comprising a first spacer region complementary to a portion of the first target nucleic acid; and ii) a second donor nucleic acid comprising: a) a barcode corresponding to the modified first target nucleic acid sequence; and b) a second guide nucleic acid sequence comprising a second spacer region complementary to a portion of a second target nucleic acid. Further disclosed are compositions wherein the modified first target nucleic acid sequence comprises at least one inserted, deleted, or substituted nucleic acid compared to a corresponding un-modified first target nucleic acid. Further disclosed are compositions wherein the first guide nucleic acid and second guide nucleic acid are compatible with a nucleic acid-guided nuclease. Further disclosed are compositions wherein the nucleic acid-guided nuclease is a Type II or Type V Cas protein. Further disclosed are compositions wherein the nucleic acid-guided nuclease is a Cas9 homologue or a Cpf1 homologue. Further disclosed are compositions wherein the second donor nucleic acid comprises a second PAM mutation. Further disclosed are compositions wherein the second donor nucleic acid sequence comprises a regulatory sequence or a mutation to turn a screenable or selectable marker on or off. Further disclosed are compositions wherein the second donor nucleic acid sequence targets a unique landing site.

Disclosed herein are methods of genome engineering, the method comprising: a) contacting a population of cells with a polynucleotide, wherein each cell comprises a first target nucleic acid, a second target nucleic acid, and a nucleic acid-guided nuclease, wherein the polynucleotide comprises 1) an editing cassette comprising: i) a modified first target nucleic acid sequence; ii) a first protospacer adjacent motif (PAM) mutation; iii) a first guide nucleic acid sequence comprising a spacer region complementary to a portion of the first target nucleic acid and compatible with the nucleic acid-guided nuclease; and 2) a recorder cassette comprising i) a barcode corresponding to the modified first target nucleic acid sequence; and ii) a second guide nucleic acid sequence comprising a second spacer region complementary to a portion of the second target nucleic acid and compatible with the nucleic acid-guided nuclease; b) allowing the first guide nucleic acid sequence, the second guide nucleic acid sequence, and the nucleic acid-guided nuclease to create a genome edit within the first target nucleic acid and the second target nucleic acid. Further disclosed are methods further comprising c) sequencing a portion of the barcode, thereby identifying the modified first target nucleic acid that was inserted within the first target nucleic acid in step a). Further disclosed are methods wherein the nucleic acid-guided nuclease is a CRISPR nuclease. Further disclosed are methods wherein the PAM mutation is not recognized by the nucleic acid-guided nuclease. Further disclosed are methods wherein the nucleic acid-guided nuclease is a Type II or Type V Cas protein. Further disclosed are methods wherein the nucleic acid-guided nuclease is a Cas9 homologue or a Cpf1 homologue. Further disclosed are methods wherein the recorder cassette further comprises a second PAM mutation that is not recognized by the nucleic acid-guided nuclease.

Disclosed herein are methods of selectable recursive genetic engineering comprising a) contacting cells comprising a nucleic acid-guided nuclease with a polynucleotide comprising a recorder cassette, said recorder cassette comprising i) a nucleic acid sequence that recombines into a unique landing site incorporated during a previous round of engineering, wherein the nucleic acid sequence comprises a unique barcode; and ii) a guide RNA compatible with the nucleic acid-guided nuclease that targets the unique landing site; and b) allowing the nucleic acid-guided nuclease to edit the unique landing site, thereby incorporating the unique barcode into the unique landing site. Further disclosed are methods wherein the nucleic acid sequence further comprises a regulatory sequence that turns transcription of a screenable or selectable marker on or off. Further disclosed are methods wherein the nucleic acid sequence further comprises a PAM mutation that is not compatible with the nucleic acid-guided nuclease. Further disclosed are methods wherein the nucleic acid sequence further comprises a second unique landing site for subsequent engineering rounds. Further disclosed are methods wherein the polynucleotide further comprises an editing cassette comprising a) a modified first target nucleic acid sequence; b) a first protospacer adjacent motif (PAM) mutation; and c) a first guide nucleic acid sequence comprising a first spacer region complementary to a portion of the first target nucleic acid, wherein the unique barcode corresponds to the modified first target nucleic acid such that the modified target nucleic acid can be identified by the unique barcode.

Provided herein are compositions comprising i) a first donor nucleic acid comprising: a) a modified first target nucleic acid sequence; b) a mutant protospacer adjacent motif (PAM) sequence; and c) a first guide nucleic acid sequence comprising a first spacer region complementary to a portion of the first target nucleic acid; and ii) a second donor nucleic acid comprising: a) a recorder sequence; and b) a second guide nucleic acid sequence comprising a second spacer region complementary to a portion of the second target nucleic acid. In some aspects, the first donor nucleic acid and the second donor nucleic acid are covalently linked or comprised on a single nucleic acid molecule. Further provided are compositions wherein the modified first target nucleic acid comprises a 5' homology are and a 3' homology arm. Further provided are compositions wherein the 5' homology arm and the 3' homology arm are homologous to nucleic acid sequence flanking a protospacer complementary to the first spacer region. Further provided are compositions wherein the modified first target nucleic acid sequence comprises at least one inserted, deleted, or substituted nucleic acid compared to a corresponding unmodified first target nucleic acid. Further provided are compositions wherein the first gRNA is compatible with a nucleic acid-guided nuclease, thereby facilitating nuclease-mediate cleavage of the first target nucleic acid. Further provided are compositions wherein the nucleic acid-guided nuclease is a Cas protein, such as a Type II or Type V Cas protein. Further provided are compositions wherein the nucleic acid-guided nuclease is Cas9 or Cpf1. Further provided are compositions wherein the nucleic acid-guided nuclease is MAD2 or MAD7. Further provided are compositions wherein the nucleic acid-guided nuclease is an engineered or non-natural enzyme. Further provided are compositions wherein the nucleic acid-guided nuclease is a engineered or non-natural enzyme derived from Cas9 or Cpf1. Further provided are compositions wherein the nucleic acid-guided nuclease is an engineered or non-natural enzyme that has less than 80% homology to either Cas9 or Cpf1. Further provided are compositions wherein the mutant PAM sequence is not recognized by the nucleic acid-guided nuclease. Further provided are compositions wherein the recorder sequence comprises a barcode. Further provided are compositions wherein the recorder sequence comprises a fragment of a screenable or selectable marker. Further provided are compositions wherein the recorder sequence comprises a unique sequence by which the modified first target nucleic acid sequence is specifically identified. Further provided are compositions wherein the recorder sequence comprises a unique sequence by which the edited cells may be selected or enriched. A first donor nucleic acid can be a cassette, such as an editing cassette as disclosed herein. A second donor nucleic acid can be a cassette, such as a recording cassette as disclosed herein. A first donor nucleic acid and a second donor nucleic acid can be comprised on a single cassette. A first donor nucleic acid and a second donor nucleic acid can be covalently linked. In any of these examples, the elements of the cassette or donor nucleic acids can be contiguous or non-contiguous.

Provided herein are cells comprising an engineered chromosome or polynucleic acid comprising: a first modified sequence; a first mutant protospacer adjacent motif (PAM); a first recorder sequence, the sequence of which uniquely identifies the first modified sequence, wherein the first modified sequence and the first recorder sequence are separated by at least 1 bp. Further provided are cells wherein the first modified sequence and the first recorder sequence are separated by at least 100 bp. Further provided are cells wherein the first modified sequence and the first recorder sequence are separated by at least 500 bp. Further provided are cells wherein the first modified sequence and the first recorder sequence are separated by at least 1 kbp. Further provided are cells wherein the first recorder sequence is a barcode. Further provided are cells wherein the first modified sequence is within a coding sequence. Further provided are cells wherein the first modified sequence comprises at least one inserted, deleted, or substituted nucleotide compared to an unmodified sequence. Further provided are cells further comprising: a second modified sequence; a second mutant PAM; and a second recorder sequence, the sequence of which uniquely identifies the second modified sequence, wherein the second modified sequence and the second recorder sequence are separated by at least 1 kb. Further provided are cells wherein the first recorder sequence and the second recorder sequence are separated by less than 100 bp. Further provided are cells wherein the second recorder sequence is a barcode. Further provided are cells wherein the second modified sequence is within a coding sequence. Further provided are cells wherein the second modified sequence comprises at least one inserted, deleted, or substituted nucleotide compared to an unmodified sequence. Further provided are cells wherein the first recorder sequence and the second recorder sequence are immediately adjacent to each other or overlapping, thereby generating a combined recorder sequence. Further provided are cells wherein the combined recorder sequence comprises a selectable or screenable marker. Further provided are cells wherein the combined recorder sequence comprises a selectable or screenable marker by which the cells may be enriched or selected.

Provided herein are methods of genome engineering, the method comprising: a) introducing into a population of cells a plurality of polynucleotides, wherein each cell comprises a first target nucleic acid, a second target nucleic acid, and a targetable nuclease, wherein each polynucleotide comprises: i) a modified first target nucleic acid sequence; ii) a mutant protospacer adjacent motif (PAM) sequence; iii) a first guide nucleic acid sequence comprising a guide sequence complementary to a portion of the first target nucleic acid; and (iv) a recorder sequence; b) inserting the modified first target nucleic acid sequence within the first target nucleic acid; c) inserting the recorder sequence within the second target nucleic acid; d) cleaving the first target nucleic acid by the targetable nuclease in cells that do not comprise the mutant PAM sequence, thereby enriching for cells comprising the inserted modified first target nucleic acid sequence. Further provided are methods wherein the recorder sequence is linked to the modified first target nucleic acid. Further provided are methods wherein each polynucleotide further comprises a second mutant PAM sequence. Further provided are methods wherein each polynucleotide further comprises a second guide nucleic acid sequence comprising a guide sequence complementary to a portion of the second target nucleic acid. Further provided are methods wherein the recorder sequence comprises a unique sequence by which the modified first target nucleic acid is specifically identified upon sequencing the recorder sequence. Further provided are methods further comprising e) sequencing the recorder sequence, thereby identifying the modified first target nucleic acid that was inserted within the first target nucleic acid in step b). Further provided are methods wherein inserting the modified first target nucleic acid sequence comprises cleaving the first target nucleic acid by the nuclease complexed with the transcription product of the first guide nucleic acid sequence. Further provided are methods wherein inserting the modified first target nucleic acid sequence further comprises homology-directed repair. Further provided are methods wherein inserting the modified first target nucleic acid sequence further comprises homologous recombination. Further provided are methods wherein the polynucleotide further comprises a second guide nucleic acid sequence comprising a spacer region complementary to a portion of the second target nucleic acid. Further provided are methods wherein inserting the recorder sequence comprises cleaving the second target nucleic acid by the nuclease complexed with the transcription product of the second guide nucleic acid sequence. Further provided are methods wherein inserting the modified first target nucleic acid sequence further comprises homology-directed repair. Further provided are methods wherein inserting the modified first target nucleic acid sequence further comprises homologous recombination. Further provided are methods wherein the targetable nuclease is a Cas protein. Further provided are methods wherein the Cas protein is a Type II or Type V Cas protein. Further provided are methods wherein the Cas protein is Cas9 or Cpf1. Further provided are methods wherein the targetable nuclease is a nucleic acid-guided nuclease. Further provided are methods wherein the targetable nuclease is MAD2 or MAD7. Further provided are methods wherein the mutant PAM sequence is not recognized by the targetable nuclease. Further provided are methods wherein the targetable nuclease is an engineered targetable nuclease. Further provided are methods wherein the mutant PAM sequence is not recognized by the engineered targetable nuclease. Further provided are methods further comprising introducing a second plurality of polynucleotides into a second population of cells comprising the enriched cells from step d), wherein each cell within the second population of cells comprises a third nucleic acid, a fourth target nucleic acid, and a targetable nuclease. Further provided are methods wherein each of the second polynucleotides comprises: i) a modified third target nucleic acid sequence; ii) a third mutant protospacer adjacent motif (PAM) sequence; iii) a third guide nucleic acid sequence comprising a spacer region complementary to a portion of the third target nucleic acid; and (iv) a second recorder sequence. Further provided are methods wherein each second polynucleotide further comprises a fourth mutant PAM sequence. Further provided are methods wherein each second polynucleotide further comprises a fourth guide nucleic acid sequence comprising a guide sequence complementary to a portion of the fourth target nucleic acid. Further provided are methods further comprising: a) inserting the modified third target nucleic acid sequence within the third target nucleic acid; b) inserting the second recorder sequence within the fourth target nucleic acid; c) cleaving the third target nucleic acid by the nuclease in cells that do not comprise the second mutant PAM sequence, thereby enriching for cells comprising the inserted modified third target nucleic acid sequence. Further provided are methods wherein the fourth target nucleic acid is adjacent to the second target nucleic acid. Further provided are methods wherein the inserted first recorder sequence is adjacent to the second recorder sequence, such that sequencing information can be obtained for the first and second recorder sequence from a single sequencing read. Further provided are methods further comprising obtaining sequence information from the first and second recorder sequences within a single sequence read, thereby identifying the modified first and third target nucleic acid sequences inserted into the first and third target nucleic acids respectively.

Provided herein are methods of identifying engineered cells, the method comprising: a) providing cells, wherein each cell comprises a first target nucleic acid, a second target nucleic acid, and a targetable nuclease, b) introducing into the cells a polynucleotide comprising: 1) a first donor nucleic acid comprising i) a modified target nucleic acid sequence; ii) a mutant protospacer adjacent motif (PAM) sequence; and iii) a first guide nucleic acid sequence comprising a first guide sequence complementary to a portion of the first target nucleic acid; and 2) a second donor nucleic acid comprising i) a recorder sequence corresponding to the modified target nucleic acid sequence; and ii) a second guide nucleic acid sequence comprising a second guide sequence complementary to a portion of the second target nucleic acid, c) cleaving the first target nucleic acid by the nuclease in cells that do not comprise the mutant PAM sequence, thereby enriching for cells comprising the modified target nucleic acid sequence, d) repeating steps a)-c) at least one time using the cells enriched for in step c) as the cells for step a) of the following round, wherein the recorder sequence from each round is incorporated adjacent to the recorder sequence from the previous round, thereby generating a record sequence array comprising a plurality of traceable barcodes, and e) sequencing the record sequence, thereby identifying engineered cells comprising a desired combination of modified target nucleic acids. Further provided are methods wherein the second donor nucleic acid further comprises a second mutant PAM sequence. Further provided are methods wherein sequencing the record sequence array comprises obtaining sequence information for each of the plurality of recorder sequences within a single sequencing read. Further provided are methods wherein steps a)-c) are repeated at least once. Further provided are methods wherein steps a)-c) are repeated at least twice. Further provided are methods wherein the recorder sequence is a barcode. Further provided are methods where the first donor nucleic acid and the second donor nucleic acid are covalently linked. A first donor nucleic acid can be a cassette, such as an editing cassette as disclosed herein. A second donor nucleic acid can be a cassette, such as a recording cassette as disclosed herein. A first donor nucleic acid and a second donor nucleic acid can be comprised on a single cassette. A first donor nucleic acid and a second donor nucleic acid can be covalently linked. In any of these examples, the elements of the cassette or donor nucleic acids can be contiguous or non-contiguous.

Provided herein are methods of identifying engineered cells, the method comprising: a) providing cells, wherein each cell comprises a first target nucleic acid, a second target nucleic acid, and a targetable nuclease, b) introducing into the cells a polynucleotide comprising: 1) a first donor nucleic acid comprising i) a modified target nucleic acid sequence; ii) a mutant protospacer adjacent motif (PAM) sequence; and iii) a first guide nucleic acid sequence comprising a first guide sequence complementary to a portion of the first target nucleic acid; and 2) a second donor nucleic acid comprising i) a marker fragment corresponding to the modified target nucleic acid sequence; and ii) a second guide nucleic acid sequence comprising a second guide sequence complementary to a portion of the second target nucleic acid, c) cleaving the first target nucleic acid by the nuclease in cells that do not comprise the mutant PAM sequence, thereby enriching for cells comprising the modified target nucleic acid sequence, d) repeating steps a)-c) at least one time using the cells enriched for in step c) as the cells for step a) of the following round, wherein the marker fragment from each round is incorporated adjacent to the marker fragment from the previous round, thereby generating a complete marker, and e) identifying cells comprising the complete marker, thereby identifying engineered cells comprising a desired combination of modified target nucleic acids. Further provided are methods wherein the second donor nucleic acid further comprises a second mutant PAM sequence. Further provided are methods wherein the complete marker comprises a selectable marker. Further provided are methods wherein the selectable marker comprises an antibiotic resistance marker or an auxotrophic marker. Further provided are methods wherein the complete marker comprises a screenable reporter. Further provided are methods wherein the screenable reporter comprises a fluorescent reporter. Further provided are methods wherein the screenable reporter comprises a gene. Further provided are methods wherein the screenable reporter comprises a promoter or regulatory element. Further provided are methods wherein the promoter or regulatory element turns on or off transcription of a screenable or selectable element. Further provided are methods wherein the screenable reporter comprises a screenable or selectable element which alters a characteristic of a colony comprising the element compared to a colony that does not comprise the element. A first donor nucleic acid can be a cassette, such as an editing cassette as disclosed herein. A second donor nucleic acid can be a cassette, such as a recording cassette as disclosed herein. A first donor nucleic acid and a second donor nucleic acid can be comprised on a single cassette. A first donor nucleic acid and a second donor nucleic acid can be covalently linked. In any of these examples, the elements of the cassette or donor nucleic acids can be contiguous or non-contiguous.

Provided herein are methods of genome engineering, the method comprising: a) introducing into a population of cells a polynucleotide, wherein each cell comprises a first target nucleic acid, a second target nucleic acid, and a targetable nuclease, wherein the polynucleotide comprises: i) a modified first target nucleic acid sequence; ii) a mutant nuclease recognition sequence; iii) a recorder sequence; b) inserting the modified first target nucleic acid sequence within the first target nucleic acid; c) inserting the recorder sequence within the second target nucleic acid; and d) selecting for a phenotype of interest. Further provided are methods wherein the polynucleotide further comprises a second mutant nuclease recognition site. Further provided are methods wherein selecting for a phenotype of interest comprises cleaving the first target nucleic acid by the nuclease in cells that do not comprise the mutant nuclease recognition sequence, thereby enriching for cells comprising the inserted modified first target nucleic acid sequence. Further provided are methods wherein selecting for a phenotype of interest comprises cleaving the second target nucleic acid by the nuclease in cells that do not comprise the second mutant nuclease recognition sequence, thereby enriching for cells comprising the inserted modified first target nucleic acid sequence. Further provided are methods wherein the recorder sequence is linked to the modified first target nucleic acid. Further provided are methods wherein the recorder sequence comprises a unique sequence by which the modified first target nucleic acid is specifically identified upon sequencing the recorder sequence. Further provided are methods further comprising e) sequencing the recorder sequence, thereby identifying the modified first target nucleic acid that was inserted within the first target nucleic acid in step b). Further provided are methods wherein inserting the modified first target nucleic acid sequence comprises homology-directed repair. Further provided are methods wherein inserting the modified first target nucleic acid sequence comprises homologous recombination. Further provided are methods wherein the nuclease is a Cas protein. Further provided are methods wherein the polynucleotide further comprises a first guide nucleic acid sequence comprising a guide sequence complementary to a portion of the first target nucleic acid. Further provided are methods wherein inserting the modified first target nucleic acid sequence comprises cleaving the first target nucleic acid by the nuclease complexed with the transcription product of the first guide nucleic acid sequence. Further provided are methods wherein the polynucleotide further comprises a second guide nucleic acid sequence comprising a guide sequence complementary to a portion of the second target nucleic acid. Further provided are methods wherein inserting the recorder sequence comprises cleaving the second target nucleic acid by the nuclease complexed with the transcription product of the second guide nucleic acid sequence. Further provided are methods wherein inserting the modified first target nucleic acid sequence or the recorder sequence comprises homology-directed repair. Further provided are methods wherein inserting the modified first target nucleic acid sequence or the recorder sequence comprises homologous recombination. Further provided are methods wherein the mutant nuclease recognition sequence comprises a mutant PAM sequence not recognized by the targetable nuclease. Further provided are methods wherein the Cas protein is a Type II or Type V Cas protein. Further provided are methods wherein the targetable nuclease is MAD2. Further provided are methods wherein the mutant PAM sequence is not recognized by MAD2. Further provided are methods wherein the targetable nuclease is MAD7. Further provided are methods wherein the mutant PAM sequence is not recognized by MAD7. Further provided are methods wherein the Cas protein is Cas9. Further provided are methods wherein the mutant PAM sequence is not recognized by Cas9. Further provided are methods wherein the Cas protein is Cpf1. Further provided are methods wherein the mutant PAM sequence is not recognized by Cpf1. Further provided are methods wherein the nuclease is an Argonaute nuclease. Further provided are methods further comprising introducing guide DNA oligonucleotides comprising a guide sequence complementary to a portion of the first target nucleic acid prior to selecting for a phenotype. Further provided are methods wherein the mutant nuclease recognition sequence comprises a mutant target flanking sequence not recognized by the Argonaute nuclease. Further provided are methods wherein the nuclease is a zinc finger nuclease. Further provided are methods wherein the mutant nuclease recognition sequence is not recognized by the zinc finger nuclease. Further provided are methods wherein the nuclease is a transcription activator-like effector nuclease (TALEN). Further provided are methods wherein the mutant nuclease recognition sequence is not recognized by the TALEN.

INCORPORATION BY REFERENCE

All publications and patent applications mentioned in this specification are herein incorporated by reference to the same extent as if each individual publication or patent application was specifically and individually indicated to be incorporated by reference.

BRIEF DESCRIPTION OF THE DRAWINGS

This patent or application file contains at least one drawing executed in color. Copies of this patent or patent application publication with color drawing(s) will be provided by the Office upon request and payment of the necessary fee.

FIGS. 1A-1C depict an example genetic engineering workflow including target design, plasmid design, and plasmid library generation. FIG. 1B discloses SEQ ID NOS 187-190, respectively, in order of appearance.

FIGS. 2A-2D depicts validation data for an example experiment using a disclosed engineering method.

FIGS. 3A-3C depict an example trackable genetic engineering workflow, including a plasmid comprising an editing cassette and a recording cassette, and downstream sequencing of barcodes in order to identify the incorporated edit or mutation. FIG. 3B discloses SEQ ID NOS 191-192, respectively, in order of appearance.

FIGS. 3D-3E depict an example trackable genetic engineering workflow, including iterative rounds of engineering with a different editing cassette and recorder cassette with unique barcode (BC) at each round, followed by selection and tracking to confirm the successful engineering step at each round.

FIG. 4B discloses SEQ ID NOS 193, 193, 194, 193, 194, 193, 193, 195, 193, 196, 193, 197, 194, 193 and 198, respectively, in order of appearance.

FIG. 5B depicts example data validating incorporation of the editing cassette and recorder cassette and selection of the engineered bacterial cells. FIG. 5A discloses the left column sequences as SEQ ID NOS 199, 200, 201, 200, 200, 200, 200, 200, 200, 200, 200, 201, 202, 200, 200, 200, 200, 200, 200, 200, 202 and 200, respectively, in order of appearance and the right column sequences as SEQ ID NOS 203, 204, 204, 204, 204, 204, 204, 204, 204, 204, 204, 203, 205, 205, 205, 205, 205, 205, 205, 205, 205 and 205, respectively, in order of appearance.

FIGS. 7A-7B depict an example plasmid curing workflow for combinatorial engineering and validation of an example experiment using said workflow.

FIG. 8A discloses SEQ ID NOS 187-190, respectively, in order of appearance.

FIGS. 9A-9D depicts validation data for an example genetic engineering experiment.

FIGS. 10A-10F depict an example data set from a genetic engineering experiment.

FIGS. 11A-11C depict an example design and data set from a genetic engineering experiment.

FIGS. 12A-12F depict an example design for a genetic engineering experiment.

FIGS. 13A-13D depict example designed edits to be made by a genetic engineering. FIG. 13A discloses SEQ ID NOS 187-190, respectively, in order of appearance. FIG. 13C discloses SEQ ID NOS 206 and 207, respectively, in order of appearance.

FIG. 15D discloses SEQ ID NOS 208 and 209, respectively, in order of appearance.

FIGS. 16A-16E depict an examples of toxicity of dsDNA cleavage in *E. coli*.

FIGS. 17A-17D depict an example of genetic engineering strategy for gene deletion. FIGS. 17A and 17C disclose SEQ ID NO: 210.

FIGS. 22A-22C depicts an example of enrichment profiles for folA editing cassettes in minimal media.

FIGS. 23A-23F depict an example of validation of identified acrB mutations for improved solvent and antibiotic tolerance.

FIGS. 27A-27C depict an example of edit and barcode correlation studies.

FIG. 30A discloses SEQ ID NO: 211.

FIGS. 31A-31B depict editing and transformation efficiencies from various nucleic acid-guided nucleases from an example experiment.

FIG. 33 depict editing efficiencies of the MAD7 nuclease with various guide nucleic acids.

DETAILED DESCRIPTION OF THE DISCLOSURE

Figure 4B:
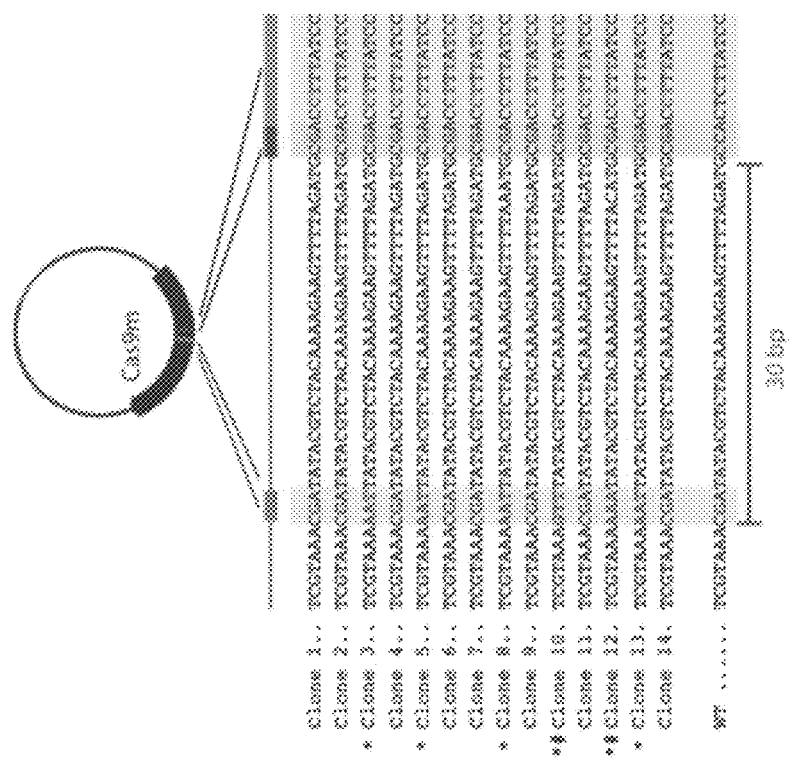
FIGS. 4A-4B depict an example of incorporation of a target mutation and PAM mutation using a plasmid comprising an editing cassette.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention.

Methods and compositions for enabling sophisticated combinatorial engineering strategies to optimize and explore complex phenotypes are provided herein. Many phenotypes of interest to basic research and biotechnology are the result of combinations of mutations that occur at distal loci. For example, cancer is often linked to mutations that influence multiple hallmark gene functions rather than a single chromosomal edit. Likewise, many metabolic and regulatory processes that are the target of continuing engineering efforts require the activities of many proteins acting in concert to produce the phenotypic output of interest. Methods and compositions disclosed herein can provide ways of rapid engineering and prototyping of such functions since they can provide rapid construction and accurate reporting on the mutational effects at many sites in parallel.

The methods and compositions described herein can be carried out or used in any type of cell in which a nucleic acid-guided nuclease system, such as CRISPR or Argonaute, or other targetable nuclease systems, such as TALEN, ZFN, or meganuclease can function (e.g., target and cleave DNA), including prokaryotic, eukaryotic, or archaeal cells. The cell can be a bacterial cell, such as *Escherichia* spp. (e.g., *E. coli*). The cell can be a fungal cell, such as a yeast cell, e.g., *Saccharomyces* spp. The cell can be a human cell. The cell can be an algal cell, a plant cell, an insect cell, or a mammalian cell, including a human cell. Additionally or alternatively, the methods described herein can be carried out in vitro or in cell-free systems in which a nucleic acid guided nuclease system, such as CRISPR or Argonaute, or other nuclease systems, such as TALEN, ZFN, or meganuclease can function (e.g., target and cleave DNA).

Disclosed herein are compositions and methods for genetic engineering. Disclosed are methods and compositions suitable for trackable or recursive genetic engineering. Disclosed method and compositions can use massively multiplexed oligonucleotide synthesis and cloning to enable high fidelity, trackable, multiplexed genome editing at single nucleotide resolution on a whole genome scale.

Trackable Plasmids

Methods and compositions can be used to perform high-fidelity trackable editing, for example, at single-nucleotide resolution and can be used to perform editing at a whole genome scale or on episomal nucleic acid molecules. Massively multiplexed oligonucleotide synthesis and/or cloning can be used in combination with a targetable nuclease system, such as a CRISPR system, MAD2 system, MAD7 system, or other nucleic acid-guided nuclease system, for editing.

As used herein, "cassette" often refers to a single molecule polynucleotide. A cassette can comprise DNA. A cassette can comprise RNA. A cassette can comprise a combination of DNA and RNA. A cassette can comprise non-naturally occurring nucleotides or modified nucleotides. A cassette can be single stranded. A cassette can be double stranded. A cassette can be synthesized as a single molecule. A cassette can be assembled from other cassettes, oligonucleotides, or other nucleic acid molecules. A cassette can comprise one or more elements. Such elements can include, as non-limiting examples, one or more of any of editing sequences, recorder sequences, guide nucleic acids, promoters, regulatory elements, mutant PAM sequences, homology arms, primer sites, linker regions, unique landing sites, a cassette, and any other element disclosed herein. Such elements can be in any order or combination. Any two or more elements can be contiguous or non-contiguous. A cassette can be comprised within a larger polynucleic acid. Such a larger polynucleic acid can be linear or circular, such as a plasmid or viral vector. A cassette can be a synthesized cassette. A cassette can be a trackable cassette.

A cassette can be designed to be used in any method or composition disclosed herein, including multiplex engineering methods and trackable engineering methods. An exemplary cassette can couple two or more elements, such as 1) a guide nucleic acid (e.g. gRNAs or gDNAs) designed for targeting a user specified target sequence in the genome and 2) an editing sequence and/or recorder sequence as disclosed herein (e.g. FIG. 1B and FIG. 5A). A cassette comprising an editing sequence and guide nucleic acid can be referred to as an editing cassette. A cassette comprising an editing sequence can be referred to as an editing cassette. A cassette comprising a recorder sequence and a guide nucleic acid can be referred to as a recorder cassette. A cassette comprising a recorder sequence can be referred to as a recorder cassette. In a preferred embodiment, an editing cassette and a recorder cassette are delivered into the cell at the same time. Further, an editing cassette and a recorder cassette may be covalently linked. Further, these elements may be synthesized together by multiplexed oligonucleotide synthesis.

A cassette can comprise one or more guide nucleic acids and editing cassette as a contiguous polynucleotide. In other examples, one or more guide nucleic acids and editing cassette are contiguous. In other examples, one or more guide nucleic acids and editing cassette are non-contiguous. In other examples, two or more guide nucleic acids and editing cassette are non-contiguous.

A cassette can comprise one or more guide nucleic acids, an editing cassette, and a recorder cassette as a contiguous polynucleotide. In other examples, one or more guide nucleic acids, editing cassette, and recorder cassette are contiguous. In other examples, two or more guide nucleic acids, editing cassette, and recorder cassette are contiguous. In other examples, one or more guide nucleic acids, editing cassette, and recorder cassette are non-contiguous. In other examples, two or more guide nucleic acids, editing cassette, and recorder cassette are non-contiguous.

A cassette can comprise one or more guide nucleic acids, one or more editing cassettes, and one or more recorder cassettes as a contiguous polynucleotide. In other examples, one or more guide nucleic acids, one or more editing cassettes, and one or more recorder cassettes are contiguous. In other examples, two or more guide nucleic acids, two or more editing cassettes, and two or more recorder cassettes are contiguous. In other examples, one or more guide nucleic acids, one or more editing cassettes, and one or more recorder cassettes are non-contiguous. In other examples, two or more guide nucleic acids, two or more editing cassettes, and two or more recorder cassettes are non-contiguous.

A cassette can comprise one or more guide nucleic acids and editing sequence as a contiguous polynucleotide. In other examples, one or more guide nucleic acids and editing sequence are contiguous. In other examples, one or more guide nucleic acids and editing sequence are non-contiguous. In other examples, two or more guide nucleic acids and editing sequence are non-contiguous.

A cassette can comprise one or more guide nucleic acids, an editing sequence, and a recorder sequence as a contiguous polynucleotide. In other examples, one or more guide nucleic acids, editing sequence, and recorder sequence are contiguous. In other examples, two or more guide nucleic acids, editing sequence, and recorder sequence are contiguous. In other examples, one or more guide nucleic acids, editing sequence, and recorder sequence are non-contiguous. In other examples, two or more guide nucleic acids, editing sequence, and recorder sequence are non-contiguous.

A cassette can comprise one or more guide nucleic acids, one or more editing sequences, and one or more recorder sequences as a contiguous polynucleotide. In other examples, one or more guide nucleic acids, one or more editing sequences, and one or more recorder sequences are contiguous. In other examples, two or more guide nucleic acids, two or more editing sequences, and two or more recorder sequences are contiguous. In other examples, one or more guide nucleic acids, one or more editing sequences, and one or more recorder sequences are non-contiguous. In other examples, two or more guide nucleic acids, two or more editing sequences, and two or more recorder sequences are non-contiguous.

An editing cassette can comprise an editing sequence. An editing sequence can comprise a mutation, such as a synonymous or non-synonymous mutation, and homology arms (HAs). An editing sequence can comprise a mutation, such as a synonymous or non-synonymous mutation, and homology arms (HAs) designed to undergo homologous recombination with the target sequence at the site of nucleic acid-guided nuclease-mediated double strand break (e.g. FIG. 1B).

A recorder cassette can comprise a recorder sequence. A recorder sequence can comprise a trackable sequence, such as a barcode or marker, and homology arms (HAs). A recorder sequence can comprise a trackable sequence, such as a barcode or marker, and homology arms (HAs) designed to undergo homologous recombination with the chromosome at the site of nucleic acid-guided nuclease-mediated double strand break (e.g. FIG. 1B).

A cassette can encode machinery (e.g. targetable nuclease, guide nucleic acid, editing cassette, and/or recorder cassette as disclosed herein) necessary to induce strand breakage as well as designed repair that can be selectively enriched and/or tracked in cells. A cell can be any cell such as eukaryotic cell, archaeal cell, prokaryotic cell, or microorganisms such as *E. coli* (e.g. FIG. 2A-2D).

A cassette can comprise an editing cassette. A cassette can comprise a recorder cassette. A cassette can comprise a guide nucleic acid and an editing cassette. A cassette can comprise a guide nucleic acid and a recorder cassette. A cassette can comprise a guide nucleic acid, an editing cassette, and a recorder cassette. A cassette can comprise two guide nucleic acids, an editing cassette, and a recorder cassette. A cassette can comprise more than two guide nucleic acids, one or more editing cassettes, and one or more recorder cassettes. These elements of a cassette can be linked covalently. These elements of a cassette can be contiguous. These elements of a cassette can be contiguous.

A cassette can comprise an editing sequence. A cassette can comprise a recorder sequence. A cassette can comprise a guide nucleic acid and an editing sequence. A cassette can comprise a guide nucleic acid and a recorder sequence. A cassette can comprise a guide nucleic acid, an editing sequence, and a recorder sequence. A cassette can comprise two guide nucleic acids, an editing sequence, and a recorder sequence. A cassette can comprise more than two guide nucleic acids, one or more editing sequences, and one or more recorder sequences. These elements of a cassette can be linked covalently. These elements of a cassette can be contiguous. These elements of a cassette can be contiguous.

Single genome edits can be tracked using sequencing technologies, e.g. short read sequencing technologies (e.g. FIG. 1C), long read sequencing technologies, or any other sequencing technologies known in the art.

In some embodiments, upon transformation, each editing cassette generates the designed genetic modification within the transformed cell. In some examples, the editing cassette can act in trans as a barcode of the genetic mutation introduced by the editing cassette and can enable the tracking of this mutation frequency in a complex population over time and across many different growth conditions (e.g. FIG. 2A-2D and FIG. 1C).

In some examples, a recording cassette inserts the designed trackable sequence, such as a marker or barcode sequence, within the transformed cell. In some examples, the recorder cassette can act in cis as a barcode of the chromosomal mutation and can enable the tracking of this mutation frequency in a complex population over time and across many different growth conditions.

By providing cis and/or trans tracking of designed genomic mutations, the methods provided herein simplify sample preparation and depth of coverage for mapping diversity genome wide, and provide powerful tools for engineering on a genome scale (e.g. FIG. 1C).

A plurality of cassettes can be pooled into a library of cassettes. A library of cassettes can comprise at least 2 cassettes. A library of cassettes can comprise from 5 to a million cassettes. A library of cassettes can comprise at least a million cassettes. It should be understood, that a library of cassettes can comprise any number of cassettes.

A library of cassettes can comprise cassettes that have any combination of common elements and non-common or unique elements as compared to the other cassettes within the pool. For example, a library of cassettes can comprise common priming sites or common homology arms while also containing non-common or unique barcodes. Common elements can be shared by a plurality, majority, or all of the cassettes within a library of cassettes. Non-common elements can be shared by a plurality, minority, or sub-population of cassettes within the library of cassettes. Unique elements can be shared by a one, a few, or a sub-population of cassettes within the library of cassettes, such that it is able to identify or distinguish the one, few, or sub-population of cassettes from the other cassettes within the library of cassettes. Such combinations of common and non-common are advantageous for multiplexing techniques as disclosed herein.

Cassettes disclosed herein can generate the designed genetic modification or insert the designed marker or barcode sequence with high efficiency within a transformed cell. In many examples, the efficiency is greater than 50%. In some examples the efficiency is 10%, 20%, 30%, 40%, 50%, 60%, 70%, 80%, 90%, 95%, 99%, or 100% (e.g., FIGS. 32A, 32B, and 33).

In some examples, transformation, editing, and/or recording efficiency can be increased by modulating the expression of one or more components disclosed herein, such as a nucleic acid-guided nuclease. Methods for modulating components are disclosed herein and are known in the art. Such methods can include expressing a component, such as a nucleic acid-guided nuclease or CRISPR enzyme of a subject system on a low or high copy plasmid, depending on the experimental design.

Disclosed herein are methods and compositions for generating cassettes. A cassettes can comprise a cassettes as disclosed herein. For example, a cassette can comprise any combination of an editing cassette and/or recorder cassette disclosed herein. Such a cassette can be comprised on a larger polynucleic acid molecule. Such a larger polynucleic acid molecule can be linear or circular, such as a plasmid or viral vector.

An editing cassette can comprise a mutation relative to a target nucleic acid sequence. The editing cassette can comprise sequence homologous to the target sequence flanking the desired mutation or editing sequence. The editing cassette can comprise a region which recognizes, or hybridizes to, a target sequence of a nucleic acid in a cell or population of cells, is homologous to the target sequence of the nucleic acid of the cell and includes a mutation, or a desired mutation, of at least one nucleotide relative to the target sequence.

An editing cassette can comprise a first editing sequence comprising a first mutation relative to a target sequence. A first mutation can comprise a mutation such as an insertion, deletion, or substitution of at least one nucleotide compared to the non-editing target sequence. The mutation can be incorporated into a coding region or non-coding region.

An editing cassette can comprise a second editing sequence comprising a second mutation relative to a target sequence. The second mutation can be designed to mutate or otherwise silence a PAM sequence such that a corresponding nucleic acid guided nuclease or CRISPR nuclease is no longer able to cleave the target sequence. In such cases, this mutation or silencing of a PAM can serve as a method for selecting transformants in which the first editing sequence has been incorporated.

In some examples, an editing cassette comprises at least two mutations, wherein one mutation is a PAM mutation. In some examples, the PAM mutation can be in a second editing cassette. Such a second editing cassette can be covalently linked and can be continuous or non-contiguous to the other elements in the cassette.

An editing cassette can comprise a guide nucleic acid, such as a gRNA encoding gene, optionally operably linked to a promoter. The guide nucleic acid can be designed to hybridize with the targeted nucleic acid sequence in which the editing sequence will be incorporated.

A recording cassette can comprise a recording sequence. A recorder sequence can comprise a barcoding sequence, or other screenable or selectable marker or fragment thereof. The recording sequence can be comprised within a recorder cassette. Recorder cassettes can comprise regions homologous to an insertion site within a target nucleic acid sequence such that the recording sequence is incorporated by homologous recombination or homology-driven repair systems. The site of incorporation of the recording cassette can be comprised on the same DNA molecule as the target nucleic acid to be edited by an editing cassette. The recorder sequence can comprise a barcode, unique DNA sequence, and/or a complete copy or fragment of a selectable or screenable element or marker.

A recorder cassette can comprise a mutation relative to the target sequence. The mutation can be designed to mutate or otherwise silence a PAM sequence such that a corresponding nucleic acid guided nuclease or CRISPR nuclease is no longer able to cleave the target sequence. In such cases, this mutation or silencing of a PAM site can serve as a method for selecting transformants in which the first recording sequence has been incorporated. A recorder cassette can comprise a PAM mutation. The PAM mutation can be designed to mutate or otherwise silence a PAM site such that a corresponding CRISPR nuclease is no longer able to cleave the target sequence. In such cases, this mutation or silencing of a PAM site can serve as a method for selecting transformants in which the recorder sequence has been incorporated.

A recorder cassette can comprise a guide nucleic acid, such as a gene encoding a gRNA. A promoter can be operably linked to a nucleic acid sequence encoding a guide nucleic acid capable of targeting a nucleic acid-guided nuclease to the desired target sequence. A guide nucleic acid can target a unique site within the target site. In some cases, the guide nucleic acid targets a unique landing site that was incorporated in a prior round of engineering. In some cases, the guide nucleic acid targets a unique landing site that was incorporated by a recorder cassette in a prior round of engineering.

A recorder cassette can comprise a barcode. A barcode can be a unique barcode or relatively unique such that the corresponding mutation can be identified based on the barcode. In some examples, the barcode is a non-naturally occurring sequence that is not found in nature. In most examples, the combination of the desired mutation and the barcode within the editing cassette is non-naturally occurring and not found in nature. A barcode can be any number of nucleotides in length. A barcode can be 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more than 30 nucleotides in length. In some cases, the barcode is more than 30 nucleotides in length. A barcode can be generated by degenerate oligonucleotide synthesis. A barcode can be rationally designed or user-specified.

A recorder cassette can comprise a landing site. A landing site can serve as a target site for a recorder cassette for a successive engineering round. A landing site can comprise a PAM. A landing site can be a unique sequence. A landing site can be at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50 nucleotides in length. In some cases, the landing site is greater than 50 nucleotides in length.

A recorder cassette can comprise a selectable or screenable marker, or a regulatory sequence or mutation that turns a selectable or screenable marker on or off. In such cases, the turning on or off of a selectable marker can be used of selection or counter-selection, respectively, of iterative rounds of engineering. An example regulatory sequence includes a ribosome-binding site (RBS), though other such regulatory sequences are envisioned. Mutations that turn a selectable or screenable marker on can include any possible start codon that is recognized by the host transcription machinery. A mutation that turns off a selectable or screenable marker includes a mutation that deletes a start codon or one that inserts a premature stop codon or a reading frame shift mutation.

A recorder cassette can comprise one or more of a guide nucleic acid targeting a target site into which the recorder sequence is to be incorporated, a PAM mutation to silence a PAM used by the guide RNA, a barcode corresponding to an editing cassette, a unique site to serve as a landing site for a recorder cassette of a subsequent rounds of engineering, a regulatory sequence or mutation that turns a screenable or selectable marker on or off, these one or more elements being flanked by homology arms that are designed to promote recombination of these one or more elements into the cleaved target site that is targeted by the guide RNA.

A recorder cassette can comprise a first homology arm, a PAM mutation, a barcode, a unique landing site, a regulatory sequence or mutation for a screenable or selectable marker, a second homology arm, and guide RNA. The first homology arm can be an upstream homology arm. The second homology arm can be a downstream homology arm. The homology arms can be homologous to sequences flanking a cleavage site that is targeted by the guide RNA.

A cassette can comprise two guide nucleic acids designed to target two distinct target nucleic acid sequences. In any case, the guide nucleic acid can comprise a single gRNA or chimeric gRNA consisting of a crRNA and trRNA sequences, or alternatively, the gRNA can comprise separated crRNA and trRNAs, or a guide nucleic acid can comprise a crRNA. In other examples, guide nucleic acid can be introduced simultaneously with a trackable polynucleic acid or plasmid comprising an editing cassette and/or recorder cassette. In these cases, the guide nucleic acid can be encoded on a separate plasmid or be delivered in RNA form via delivery methods well known in the art.

A cassette can comprise a gene encoding a nucleic acid-guided nuclease, such as a CRISPR nuclease, functional with the chosen guide nucleic acid. A nucleic acid-guided nuclease or CRISPR nuclease gene can be provided on a separate plasmid. A nucleic acid-guided nuclease or CRISPR nuclease can be provided on the genome or episomal plasmid of a host organism to which a trackable polynucleic acid or plasmid will be introduced. In any of these examples, the nucleic acid-guided nuclease or CRISPR nuclease gene can be operably linked to a constitutive or inducible promoter. Examples of suitable constitutive and inducible promoters are well known in the art. A nucleic acid-guided nuclease or CRISPR nuclease can be provided as mRNA or polypeptide using delivery systems well known in the art. Such mRNA or polypeptide delivery systems can include, but are not limited to, nanoparticles, viral vectors, or other cell-permeable technologies.

A cassette can comprise a selectable or screenable marker, for example, such as that comprised within a recorder cassette. For example, the recorder cassette can comprise a barcode, such as trackable nucleic acid sequence which can be uniquely correlated with a genetic mutation of the corresponding editing cassette, or otherwise identifiably correlated with such a genetic mutation such that sequencing the barcode will allow identification of the corresponding genetic mutation introduced by the editing cassette. In other examples, recorder cassette can comprise a complete copy of or a fragment of a gene encoding an antibiotic resistance gene, auxotrophic marker, fluorescent protein, or other known selectable or screenable markers.

Trackable Plasmid Libraries

A trackable library can comprise a plurality of cassettes as disclosed herein. A trackable library can comprise a plurality of trackable polynucleic acids or plasmids comprising a cassette as disclosed herein. A cassette, polynucleotide, or plasmid comprising a recorder sequence or recorder cassette as disclosed herein can be referred to as a trackable cassette, polynucleotide, or plasmid. A cassette, polynucleotide, or plasmid comprising an editing sequence or editing cassette as disclosed herein can be referred to as a trackable cassette, polynucleotide, or plasmid.

In some cases, within the trackable library are distinct editing cassette and recorder cassette combinations that are sequenced to determine which editing sequence corresponds with a given marker or barcode sequence comprised within the recorder cassette. Therefore, when the editing and recorder sequences are incorporated into a target sequence, you can determine the edit that was incorporated by sequencing the recorder sequence. Sequence the recorder sequence or barcode can significantly cut down on sequencing time and cost.

Library size can depend on the experiment design. For example, if the aim is to edit each amino acid within a protein of interest, then the library size can depend on the number (N) of amino acids in a protein of interest, with a full saturation library (all 20 amino acids at each position or non-naturally occurring amino acids) scaling as 19 (or more)×N and an alanine-mapping library scaling as 1×N. Thus, screening of even very large proteins of more than 1,000 amino acids can be tractable given current multiplex oligo synthesis capabilities (e.g. 120,000 oligos). In addition to or as an alternative to activity screens, more general properties with developed high-throughput screens and selections can be efficiently tested using the libraries disclosed herein. It should be readily understood that libraries can be designed to mutate any number of amino acids within a target protein, including 1, at least 1, 2, 3, 4, 5, 6, 7, 8, 9, 10, etc. up to the total number of amino acids within a target protein. Additionally, select amino acids can be targeted, such as catalytically active amino acids, or those involved in protein-protein interactions. Each amino acid that is targeted for mutation can be mutated into any number of alternate amino acids, such as any other natural or non-naturally occurring amino acid or amino acid analog. In some examples, all targeted amino acids are mutated to the same amino acid, such as alanine. In other cases, the targeted amino acids are independently mutated to any other amino acid in any combination or permutation.

Trackable libraries can comprise trackable mutations in individual residues or sequences of interest. Trackable libraries can be generated using custom-synthesized oligonucleotide arrays. Trackable plasmids can be generated using any cloning or assembly methods known in the art. For example, CREATE-Recorder plasmids can be generated by chemical synthesis, Gibson assembly, SLIC, CPEC, PCA, ligation-free cloning, other in vitro oligo assembly techniques, traditional ligation-based cloning, or any combination thereof.

Recorder sequences, such as barcodes, can be designed in silico via standard code with a degenerate mutation at the target codon. The degenerate mutation can comprise 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more than 30 nucleic acid residues. In some examples, the degenerate mutations can comprise 15 nucleic acid residues (N15).

Homology arms can be added to a recorder sequence and/or editing sequence to allow incorporation of the recorder and/or editing sequence into the desired location via homologous recombination or homology-driven repair. Homology arms can be added by synthesis, in vitro assembly, PCR, or other known methods in the art. For example, homology arms can be assembled via overlapping oligo extension, Gibson assembly, or any other method disclosed herein. A homology arm can be added to both ends of a recorder and/or editing sequence, thereby flanking the sequence with two distinct homology arms, for example, a 5' homology arm and a 3' homology arm.

The same 5' and 3' homology arms can be added to a plurality of distinct recorder sequences, thereby generating a library of unique recorder sequences that each have the same spacer target or targeted insertion site. The same 5' and 3' homology arms can be added to a plurality of distinct editing sequences, thereby generating a library of unique editing sequences that each have the same spacer target or targeted insertion site. In alternative examples, different or a variety of 5' or 3' homology arms can be added to a plurality of recorder sequences or editing sequences.

A recorder sequence library comprising flanking homology arms can be cloned into a vector backbone. In some examples, the recorder sequence and homology arms are cloned into a recorder cassette. Recorder cassettes can, in some cases, further comprise a nucleic acid sequence encoding a guide nucleic acid or gRNA engineered to target the desired site of recorder sequence insertion. In many cases, the nucleic acid sequences flanking the CRISPR/Cas-mediated cleavage site are homologous or substantially homologous to the homology arms comprised within the recorder cassette.

An editing sequence library comprising flanking homology arms can be cloned into a vector backbone. In some examples, the editing sequence and homology arms are cloned into an editing cassette. Editing cassettes can, in some cases, further comprise a nucleic acid sequence encoding a guide nucleic acid or gRNA engineered to target the desired site of editing sequence insertion. In many cases, the nucleic acid sequences flanking the CRISPR/Cas-mediated cleavage site are homologous or substantially homologous to the homology arms comprised within the editing cassette.

Gene-wide or genome-wide editing libraries can be subcloned into a vector backbone. In some cases, the vector backbone comprises a recorder cassette as disclosed herein. The editing sequence library can be inserted or assembled into a second site to generate competent trackable plasmids that can embed the recording barcode at a fixed locus while integrating the editing libraries at a wide variety of user defined sites.

A recorder sequence and/or cassette can be assembled or inserted into a vector backbone first, followed by insertion of an editing sequence and/or cassette. In other cases, an editing sequence and/or cassette can be inserted or assembled into a vector backbone first, followed by insertion of a recorder sequence and/or cassette. In other cases, a recorder sequence and/or cassette and an editing sequence and/or cassette are simultaneous inserted or assembled into a vector. In other cases, a recorder sequence and/or cassette and an editing sequence and/or cassette are comprised on the same cassette prior to simultaneous insertion or assembly into a vector. In other cases, a recorder sequence and/or cassette and an editing sequence and/or cassette are linked prior to simultaneous insertion or assembly into a vector. In other cases, a recorder sequence and/or cassette and an editing sequence and/or cassette are covalently linked prior to simultaneous insertion or assembly into a vector. In any of these cases, trackable plasmids or plasmid libraries can be generated.

A cassette or nucleic acid molecule can be synthesized which comprises one or more elements disclosed herein. For example, a nucleic acid molecule can be synthesized that comprises an editing cassette and a guide nucleic acid. A nucleic acid molecule can be synthesized that comprises an editing cassette and a recorder cassette. A nucleic acid molecule can be synthesized that comprises an editing cassette, a guide nucleic acid, and a recorder cassette. A nucleic acid molecule can be synthesized that comprises an editing cassette, a recorder cassette, and two guide nucleic acids. A nucleic acid molecule can be synthesized that comprises a recorder cassette and a guide nucleic acid. A nucleic acid molecule can be synthesized that comprises a recorder cassette. A nucleic acid molecule can be synthesized that comprises an editing cassette. In any of these cases, the guide nucleic acid can optionally be operably linked to a promoter. In any of these cases, the nucleic acid molecule can further include one or more barcodes.

Synthesized cassettes or synthesized nucleic acid molecules can be synthesized using any oligonucleotide synthesis method known in the art. For example, cassettes can be synthesized by array based oligonucleotide synthesis. In such examples, following synthesis of the oligonucleotides, the oligonucleotides can be cleaved from the array. Cleavage of oligonucleotides from an array can create a pool of oligonucleotides.

Software and automation methods can be used for multiplex synthesis and generation. For example, software and automation can be used to create $10$, $10^2$, $10^3$, $10^4$, $10^5$, $10^6$, or more cassettes, such as trackable cassettes. An automation method can generate trackable plasmids in rapid fashion. Trackable cassettes can be processed through a workflow with minimal steps to produce precisely defined genome-wide libraries.

Cassette libraries, such as trackable cassette libraries, can be generated which comprise two or more nucleic acid molecules or plasmids comprising any combination disclosed herein of recorder sequence, editing sequence, guide nucleic acid, and optional barcode, including combinations of one or more of any of the previously mentioned elements. For example, such a library can comprise at least 2, 3, 4, 5, 10, 20, 30, 40, 50, 60, 70, 80, 90, 100, 200, 300, 400, 500, 600, 700, 800, 1000, 1500, 2000, 2500, 3000, 3500, 4000, 4500, 5000, 5500, 6000, 6500, 7000, 7500, 8000, 8500, 9000, 9500, $10^4$, $10^5$, $10^6$, $10^7$, $10^8$, $10^9$, $10^{10}$, or more nucleic acid molecules or plasmids of the present disclosure. It should be understood that such a library can include any number of nucleic acid molecules or plasmids, even if the specific number is not explicit listed above.

Cassettes or cassette libraries can be sequenced in order to determine the recorder sequence and editing sequence pair that is comprised on each cassette. In other cases, a known recorder sequence is paired with a known editing sequence during the library generation process. Other methods of determining the association between a recorder sequence and editing sequence comprised on a common nucleic acid molecule or plasmid are envisioned such that the editing sequence can be identified by identification or sequencing of the recorder sequence.

Methods and compositions for tracking edited episomal libraries that are shuttled between *E. coli* and other organisms/cell lines are provided herein. The libraries can be comprised on plasmids, Bacterial artificial chromosomes (BACs), Yeast artificial chromosomes (YACs), synthetic chromosomes, or viral or phage genomes. These methods and compositions can be used to generate portable barcoded libraries in host organisms, such as *E. coli*. Library generation in such organisms can offer the advantage of established techniques for performing homologous recombination. Barcoded plasmid libraries can be deep-sequenced at one site to track mutational diversity targeted across the remaining portions of the plasmid allowing dramatic improvements in the depth of library coverage (e.g. FIG. 3A).

Trackable Engineering Methods

An example of trackable engineering workflow is depicted in FIG. 3A. Each plasmid can encode a recorder cassette designed to edit a site in the target DNA (e.g. FIG. 3A, black cassette). Sites to be targeted can be functionally neutral sites, or they can be a screenable or selectable marker gene. The homology arm (HA) of the recorder cassette can contain a recorder sequence (e.g., FIG. 3B) that is inserted into the recording site during recombineering. Recombineering can comprise DNA cleavage, such as nucleic acid-guided nuclease-mediated DNA cleavage, and repair via homologous recombination. The recorder sequence can comprise a barcode, unique DNA sequence, or a complete copy or fragment of a screenable or selectable marker. In some examples, the recorder sequence is 15 nucleotides. The recorder sequence can comprise less than 10, 10, 11, 12, 13, 14, 15, 16, 17, 18, 19, 20, 25, 30, 35, 40, 45, 50, 55, 60, 65, 70, 75, 80, 88, 90, 100, 110, 120, 130, 140, 150, 160, 170, 180, 190, 200, or more than 200 nucleotides.

Through a multiplexed cloning approach, the recorder cassette can be covalently coupled to at least one editing cassette in a plasmid (e.g., FIG. 3A, green cassette) to generate trackable plasmid libraries that have a unique recorder and editing cassette combination. This trackable library can be sequenced to generate the recorder/edit mapping and used to track editing libraries across large segments of the target DNA (e.g., FIG. 3C). Recorder and editing sequences can be comprised on the same polynucleotide, in which case they are both incorporated into the target nucleic acid sequence, such as a genome or plasmid, by the same recombination event. In other examples, the recorder and editing sequences can be comprised on separate cassettes within the same trackable plasmid, in which case the recorder and editing sequences are incorporated into the target nucleic acid sequence by separate recombination events, either simultaneously or sequentially.

Methods are provided herein for combining multiplex oligonucleotide synthesis with recombineering, to create libraries of specifically designed and trackable mutations. Screens and/or selections followed by high-throughput sequencing and/or barcode microarray methods can allow for rapid mapping of mutations leading to a phenotype of interest.

Methods and compositions disclosed herein can be used to simultaneously engineer and track engineering events in a target nucleic acid sequence.

Trackable plasmids can be generated using in vitro assembly or cloning techniques. For example, the CREATE-Recorder plasmids can be generated using chemical synthesis, Gibson assembly, SLIC, CPEC, PCA, ligation-free cloning, other in vitro oligo assembly techniques, traditional ligation-based cloning, or any combination thereof.

Trackable plasmids can comprise at least one recording sequence, such as a barcode, and at least one editing sequence. In most cases, the recording sequence is used to record and track engineering events. Each editing sequence can be used to incorporate a desired edit into a target nucleic acid sequence. The desired edit can include insertion, deletion, substitution, or alteration of the target nucleic acid sequence. In some examples, the one or more recording sequence and editing sequences are comprised on a single cassette comprised within the trackable plasmid such that they are incorporated into the target nucleic acid sequence by the same engineering event. In other examples, the recording and editing sequences are comprised on separate cassettes within the trackable plasmid such that they are each incorporated into the target nucleic acid by distinct engineering events. In some examples, the trackable plasmid comprises two or more editing sequences. For example, one editing sequence can be used to alter or silence a PAM sequence while a second editing sequence can be used to incorporate a mutation into a distinct sequence.

Recorder sequences can be inserted into a site separated from the editing sequence insertion site. The inserted recorder sequence can be separated from the editing sequence by 1 bp or any number of base pairs. For example, the separation distance can be about 1 bp, 10 bp, 50 bp, 100 bp, 500 bp, 1 kp, 2 kb, 5 kb, 10 kb, or greater. The separation distance can be any discrete integer of base pairs. It should be readily understood that there the limit of the number of base pairs separating the two insertion sites can be limited by the size of the genome, chromosome, or polynucleotide into which the insertions are being made. In some examples, the maximum distance of separation depends on the size of the target nucleic acid or genome.

Recorder sequences can be inserted adjacent to editing sequences, or within proximity to the editing sequence. For example, the recorder sequence can be inserted outside of the open reading frame within which the editing sequence is inserted. Recorder sequence can be inserted into an untranslated region adjacent to an open reading frame within which an editing sequence has been inserted. The recorder sequence can be inserted into a functionally neutral or non-functional site. The recorder sequence can be inserted into a screenable or selectable marker gene.

In some examples, the target nucleic acid sequence is comprised within a genome, artificial chromosome, synthetic chromosome, or episomal plasmid. In various examples, the target nucleic acid sequence can be in vitro or in vivo. When the target nucleic acid sequence is in vivo, the CREATE-Recorder plasmid can be introduced into the host organisms by transformation, transfection, conjugation, biolistics, nanoparticles, cell-permeable technologies, or other known methods for DNA delivery, or any combination thereof. In such examples, the host organism can be a eukaryote, prokaryote, bacterium, archaea, yeast, or other fungi.

The engineering event can comprise recombineering, non-homologous end joining, homologous recombination, or homology-driven repair. In some examples, the engineering event is performed in vitro or in vivo.

The methods described herein can be carried out in any type of cell in which a nucleic acid-guided nuclease system can function (e.g., target and cleave DNA), including prokaryotic and eukaryotic cells or in vitro. In some embodiments the cell is a bacterial cell, such as *Escherichia* spp. (e.g., *E. coli*). In other embodiments, the cell is a fungal cell, such as a yeast cell, e.g., *Saccharomyces* spp. In other embodiments, the cell is an algal cell, a plant cell, an insect cell, or a mammalian cell, including a human cell.

In some examples, a cell is a recombinant organism. For example, the cell can comprise a non-native nucleic acid-guided nuclease system. Additionally or alternatively, the cell can comprise recombination system machinery. Such recombination systems can include lambda red recombination system, Cre/Lox, attB/attP, or other integrase systems. Where appropriate, the trackable plasmid can have the complementary components or machinery required for the selected recombination system to work correctly and efficiently.

A method for genome editing can comprise: (a) introducing a vector that encodes at least one editing cassette and at least one guide nucleic acid into a first population of cells, thereby producing a second population of cells comprising the vector; (b) maintaining the second population of cells under conditions in which a nucleic acid-guided nuclease is expressed or maintained, wherein the nucleic acid-guided nuclease is encoded on the vector, a second vector, on the genome of cells of the second population of cells, or otherwise introduced into the cell, resulting in DNA cleavage and incorporation of the editing cassette; (c) obtaining viable cells. Such a method can optionally further comprise (d) sequencing the target DNA molecule in at least one cell of the second population of cells to identify the mutation of at least one codon.

A method for genome editing can comprise: (a) introducing a vector that encodes at least one editing cassette comprising a PAM mutation as disclosed herein and at least one guide nucleic acid into a first population of cells, thereby producing a second population of cells comprising the vector; (b) maintaining the second population of cells under conditions in which nucleic acid-guided nuclease is expressed or maintained, wherein the nucleic acid-guided nuclease is encoded on the vector, a second vector, on the genome of cells of the second population of cells, or otherwise introduced into the cell, resulting in DNA cleavage, incorporation of the editing cassette, and death of cells of the second population of cells that do not comprise the PAM mutation, whereas cells of the second population of cells that comprise the PAM mutation are viable; (c) obtaining viable cells. Such a method can optionally further comprise (d) sequencing the target DNA in at least one cell of the second population of cells to identify the mutation of at least one codon.

Method for trackable genome editing can comprise: (a) introducing a vector that encodes at least one editing cassette, at least one recorder cassette, and at least two gRNA into a first population of cells, thereby producing a second population of cells comprising the vector; (b) maintaining the second population of cells under conditions in which a nucleic acid-guided nuclease is expressed or maintained, wherein the nucleic acid-guided nuclease is encoded on the vector, a second vector, on the genome of cells of the second population of cells, or otherwise introduced into the cell, resulting in DNA cleavage and incorporation of the editing and recorder cassettes; (c) obtaining viable cells. Such a method can optionally further comprise (d) sequencing the recorder sequence of the target DNA molecule in at least one cell of the second population of cells to identify the mutation of at least one codon.

In some examples where the trackable plasmid comprises an editing cassette designed to silence a PAM site, a method for trackable genome editing can comprise: (a) introducing a vector that encodes at least one editing cassette, a recorder cassette, and at least two gRNA into a first population of cells, thereby producing a second population of cells comprising the vector; (b) maintaining the second population of cells under conditions in which a nucleic acid-guided nuclease is expressed or maintained, wherein the nucleic acid-guided nuclease is encoded on the vector, a second vector, on the genome of cells of the second population of cells, or otherwise introduced into the cell, resulting in DNA cleavage, incorporation of the editing cassette and recorder cassette, and death of cells of the second population of cells that do not comprise the PAM mutation, whereas cells of the second population of cells that comprise the PAM mutation are viable; and (c) obtaining viable cells. Such a method can optionally further comprise (d) sequencing the recorder sequence of the target DNA in at least one cell of the second population of cells to identify the mutation of at least one codon. Such methods can also further comprise a recorder cassette comprising a second PAM mutation, such that both PAMs must be silences by the editing cassette PAM mutation and recorder cassette PAM mutation in order to escape cell death.

In some examples transformation efficiency is determined by using a non-targeting guide nucleic acid control, which allows for validation of the recombineering procedure and CFU/ng calculations. In some cases, absolute efficient is obtained by counting the total number of colonies on each transformation plate, for example, by counting both red and white colonies from a galK control. In some examples, relative efficiency is calculated by the total number of successful transformants (for example, white colonies) out of all colonies from a control (for example, galK control).

The methods of the disclosure can provide, for example, greater than 1000× improvements in the efficiency, scale, cost of generating a combinatorial library, and/or precision of such library generation.

The methods of the disclosure can provide, for example, greater than: 10×, 50×, 100×, 200×, 300×, 400×, 500×, 600×, 700×, 800×, 900×, 1000×, 1100×, 1200×, 1300×, 1400×, 1500×, 1600×, 1700×, 1800×, 1900×, 2000×, or greater improvements in the efficiency of generating genomic or combinatorial libraries.

The methods of the disclosure can provide, for example, greater than: 10×, 50×, 100×, 200×, 300×, 400×, 500×, 600×, 700×, 800×, 900×, 1000×, 1100×, 1200×, 1300×, 1400×, 1500×, 1600×, 1700×, 1800×, 1900×, 2000×, or greater improvements in the scale of generating genomic or combinatorial libraries.

The methods of the disclosure can provide, for example, greater than: 10×, 50×, 100×, 200×, 300×, 400×, 500×, 600×, 700×, 800×, 900×, 1000×, 1100×, 1200×, 1300×, 1400×, 1500×, 1600×, 1700×, 1800×, 1900×, 2000×, or greater decrease in the cost of generating genomic or combinatorial libraries.

The methods of the disclosure can provide, for example, greater than: 10×, 50×, 100×, 200×, 300×, 400×, 500×, 600×, 700×, 800×, 900×, 1000×, 1100×, 1200×, 1300×, 1400×, 1500×, 1600×, 1700×, 1800×, 1900×, 2000×, or greater improvements in the precision of genomic or combinatorial library generation.

Recursive Tracking for Combinatorial Engineering

Disclosed herein are methods and compositions for iterative rounds of engineering. Disclosed herein are recursive engineering strategies that allow implementation of trackable engineering at the single cell level through several serial engineering cycles (e.g., FIG. 3D or FIG. 6). These disclosed methods and compositions can enable search-based technologies that can effectively construct and explore complex genotypic space. The terms recursive and iterative can be used interchangeably.

Combinatorial engineering methods can comprise multiple rounds of engineering. Methods disclosed herein can comprise 2 or more rounds of engineering. For example, a method can comprise 2, 3, 4, 5, 6, 7, 8, 9, 10, 11, 12, 13, 14, 15, 20, 25, 30, or more than 30 rounds of engineering.

In some examples, during each round of engineering a new recorder sequence, such as a barcode, is incorporated at the same or nearby locus in a target site (e.g., FIG. 3D, green bars or FIG. 6, black bars) such that following multiple engineering cycles to construct combinatorial diversity throughout the genome (e.g., FIG. 3E, green bars or FIG. 6, grey bars) a PCR, or similar reaction, of the recording locus can be used to reconstruct each combinatorial genotype or to confirm that the engineered edit from each round has been incorporated into the target site.

Disclosed herein are methods for selecting for successive rounds of engineering. Selection can occur by a PAM mutation incorporated by an editing cassette. Selection can occur by a PAM mutation incorporated by a recorder cassette. Selection can occur using a screenable, selectable, or counter-selectable marker. Selection can occur by targeting a site for editing or recording that was incorporated by a prior round of engineering, thereby selecting for variants that successfully incorporated edits and recorder sequences from both rounds or all prior rounds of engineering.

Quantitation of these genotypes can be used for understanding combinatorial mutational effects on large populations and investigation of important biological phenomena such as epistasis.

Serial editing and combinatorial tracking can be implemented using recursive vector systems as disclosed herein. These recursive vector systems can be used to move rapidly through the transformation procedure (e.g., FIG. 7A). In some examples, these systems consist of two or more plasmids containing orthogonal replication origins, antibiotic markers, and gRNAs. The gRNA in each vector can be designed to target one of the other resistance markers for destruction by nucleic acid-guided nuclease-mediated cleavage. These systems can be used, in some examples, to perform transformations in which the antibiotic selection pressure is switched to remove the previous plasmid and drive enrichment of the next round of engineered genomes. Two or more passages through the transformation loop can be performed, or in other words, multiple rounds of engineering can be performed. Introducing the requisite recording cassettes and editing cassettes into recursive vectors as disclosed herein can be used for simultaneous genome editing and plasmid curing in each transformation step with high efficiencies.

In some examples, the recursive vector system disclosed herein comprises 2, 3, 4, 5, 6, 7, 8, 9, 10, or more than 10 unique plasmids. In some examples, the recursive vector system can use a particular plasmid more than once as long as a distinct plasmid is used in the previous round and in the subsequent round.

Recursive methods and compositions disclosed herein can be used to restore function to a selectable or screenable element in a targeted genome or plasmid. The selectable or screenable element can include an antibiotic resistance gene, a fluorescent gene, a unique DNA sequence or watermark, or other known reporter, screenable, or selectable gene. In some examples, each successive round of engineering can incorporate a fragment of the selectable or screenable element, such that at the end of the engineering rounds, the entire selectable or screenable element has been incorporated into the target genome or plasmid. In such examples, only those genome or plasmids, which have successfully incorporated all of the fragments, and therefore all of the desired corresponding mutations, can be selected or screened for. In this way, the selected or screened cells will be enriched for those that have incorporated the edits from each and every iterative round of engineering.

Recursive methods can be used to switch a selectable or screenable marker between an on and an off position, or between an off and an on position, with each successive round of engineering. Using such a method allows conservation of available selectable or screenable markers by requiring, for example, the use of only one screenable or selectable marker. Furthermore, short regulatory sequence or start codon or non-start codons can be used to turn the screenable or selectable marker on and off. Such short sequences can easily fit within a cassette or polynucleotide, such as a synthesized cassette.

One or more rounds of engineering can be performed using the methods and compositions disclosed herein. In some examples, each round of engineering is used to incorporate an edit unique from that of previous rounds. Each round of engineering can incorporate a unique recording sequence. Each round of engineering can result in removal or curing of the CREATE plasmid used in the previous round of engineering. In some examples, successful incorporation of the recording sequence of each round of engineering results in a complete and functional screenable or selectable marker or unique sequence combination.

Unique recorder cassettes comprising recording sequences such as barcodes or screenable or selectable markers can be inserted with each round of engineering, thereby generating a recorder sequence that is indicative of the combination of edits or engineering steps performed. Successive recording sequences can be inserted adjacent to one another. Successive recording sequences can be inserted within proximity to one another. Successive sequences can be inserted at a distance from one another.

Successive sequences can be inserted at a distance from one another. For example, successive recorder sequences can be inserted and separated by 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 78, 79, 80, 81, 82, 83, 84, 85, 86, 87, 88, 89, 90, 91, 92, 93, 94, 95, 96, 97, 98, 99, 100, or greater than 100 bp. In some examples, successive recorder sequences are separated by about 10, 50, 100, 150, 200, 250, 300, 350, 400, 450, 500, 550, 600, 650, 700, 750, 800, 850, 900, 950, 1000, 1100, 1200, 1300, 1400, 1500, or greater than 1500 bp.

Successive recorder sequences can be separated by any desired number of base pairs and can be dependent and limited on the number of successive recorder sequences to be inserted, the size of the target nucleic acid or target genomes, and/or the design of the desired final recorder sequence. For example, if the compiled recorder sequence is a functional screenable or selectable marker, than the successive recording sequences can be inserted within proximity and within the same reading frame from one another. If the compiled recorder sequence is a unique set of barcodes to be identified by sequencing and have no coding sequence element, then the successive recorder sequences can be inserted with any desired number of base pairs separating them. In these cases, the separation distance can be dependent on the sequencing technology to be used and the read length limit.

In some examples, a recorder cassette comprises a landing site to be used as a target site for the recorder cassette of the next round of engineering. By using such a method, successive rounds of recorder cassettes can only be introduced into the target site if the recorder cassette from the previous round was successfully incorporated, thereby providing the target site for the present engineering round (e.g., FIG. 28).

Guide Nucleic Acid

A guide nucleic acid can complex with a compatible nucleic acid-guided nuclease and can hybridize with a target sequence, thereby directing the nuclease to the target sequence. A subject nucleic acid-guided nuclease capable of complexing with a guide nucleic acid can be referred to as a nucleic acid-guided nuclease that is compatible with the guide nucleic acid. Likewise, a guide nucleic acid capable of complexing with a nucleic acid-guided nuclease can be referred to as a guide nucleic acid that is compatible with the nucleic acid-guided nucleases.

A guide nucleic acid can be DNA. A guide nucleic acid can be RNA. A guide nucleic acid can comprise both DNA and RNA. A guide nucleic acid can comprise modified of non-naturally occurring nucleotides. In cases where the guide nucleic acid comprises RNA, the RNA guide nucleic acid can be encoded by a DNA sequence on a polynucleotide molecule such as a plasmid, linear construct, or editing cassette as disclosed herein.

A guide nucleic acid can comprise a guide sequence. A guide sequence is a polynucleotide sequence having sufficient complementarity with a target polynucleotide sequence to hybridize with the target sequence and direct sequence-specific binding of a complexed nucleic acid-guided nuclease to the target sequence. The degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences. In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20 nucleotides in length. Preferably the guide sequence is 10-30 nucleotides long. The guide sequence can be 15-20 nucleotides in length. The guide sequence can be 15 nucleotides in length. The guide sequence can be 16 nucleotides in length. The guide sequence can be 17 nucleotides in length. The guide sequence can be 18 nucleotides in length. The guide sequence can be 19 nucleotides in length. The guide sequence can be 20 nucleotides in length.

A guide nucleic acid can comprise a scaffold sequence. In general, a "scaffold sequence" includes any sequence that has sufficient sequence to promote formation of a targetable nuclease complex, wherein the targetable nuclease complex comprises a nucleic acid-guided nuclease and a guide nucleic acid comprising a scaffold sequence and a guide sequence. Sufficient sequence within the scaffold sequence to promote formation of a targetable nuclease complex may include a degree of complementarity along the length of two sequence regions within the scaffold sequence, such as one or two sequence regions involved in forming a secondary structure. In some cases, the one or two sequence regions are comprised or encoded on the same polynucleotide. In some cases, the one or two sequence regions are comprised or encoded on separate polynucleotides. Optimal alignment may be determined by any suitable alignment algorithm, and may further account for secondary structures, such as self-complementarity within either the one or two sequence regions. In some embodiments, the degree of complementarity between the one or two sequence regions along the length of the shorter of the two when optimally aligned is about or more than about 25%, 30%, 40%, 50%, 60%, 70%, 80%, 90%, 95%, 97.5%, 99%, or higher. In some embodiments, at least one of the two sequence regions is about or more than about 5, 6, 7, 8, 9, 10, 11, 12, 13, 14, 15, 16, 17, 18, 19, 20, 25, 30, 40, 50, or more nucleotides in length.

A scaffold sequence of a subject guide nucleic acid can comprise a secondary structure. A secondary structure can comprise a pseudoknot region. In some example, the compatibility of a guide nucleic acid and nucleic acid-guided nuclease is at least partially determined by sequence within or adjacent to a pseudoknot region of the guide RNA. In some cases, binding kinetics of a guide nucleic acid to a nucleic acid-guided nuclease is determined in part by secondary structures within the scaffold sequence. In some cases, binding kinetics of a guide nucleic acid to a nucleic acid-guided nuclease is determined in part by nucleic acid sequence with the scaffold sequence.

In aspects of the invention the terms "guide nucleic acid" refers to a polynucleotide comprising 1) a guide sequence capable of hybridizing to a target sequence and 2) a scaffold sequence capable of interacting with or complexing with an nucleic acid-guided nuclease as described herein.

A guide nucleic acid can be compatible with a nucleic acid-guided nuclease when the two elements can form a functional targetable nuclease complex capable of cleaving a target sequence. Often, a compatible scaffold sequence for a compatible guide nucleic acid can be found by scanning sequences adjacent to a native nucleic acid-guided nuclease loci. In other words, native nucleic acid-guided nucleases can be encoded on a genome within proximity to a corresponding compatible guide nucleic acid or scaffold sequence.

Nucleic acid-guided nucleases can be compatible with guide nucleic acids that are not found within the nucleases endogenous host. Such orthogonal guide nucleic acids can be determined by empirical testing. Orthogonal guide nucleic acids can come from different bacterial species or be synthetic or otherwise engineered to be non-naturally occurring.

Orthogonal guide nucleic acids that are compatible with a common nucleic acid-guided nuclease can comprise one or more common features. Common features can include sequence outside a pseudoknot region. Common features can include a pseudoknot region. Common features can include a primary sequence or secondary structure.

A guide nucleic acid can be engineered to target a desired target sequence by altering the guide sequence such that the guide sequence is complementary to the target sequence, thereby allowing hybridization between the guide sequence and the target sequence. A guide nucleic acid with an engineered guide sequence can be referred to as an engineered guide nucleic acid. Engineered guide nucleic acids are often non-naturally occurring and are not found in nature.

More Methods

Disclosed herein are methods for genome engineering that employ a nuclease, such as a nucleic acid-guided nuclease to perform directed genome evolution/produce changes (deletions, substitutions, additions) in a target sequence, such as DNA or RNA, for example, genomic DNA or episomal DNA. Suitable nucleases can include, for example, RNA-guided nucleases such as Cas9, Cpf1, MAD2, or MAD7, DNA-guided nucleases such as Argonaute, or other nucleases such as zinc-finger nucleases, TALENs, or meganucleases. Nuclease genes can be obtained from any source, such as from a bacterium, archaea, prokaryote, eukaryote, or virus. For example, a Cas9 gene can be obtained from a bacterium harboring the corresponding Type II CRISPR system, such as the bacterium *S. pyogenes* (SEQ ID NO: 110). The nucleic acid sequence and/or amino acid sequence of the nuclease may be mutated, relative to the sequence of a naturally occurring nuclease. A mutation can be, for example, one or more insertions, deletions, substitutions or any combination of two or three of the foregoing. In some cases, the resulting mutated nuclease can have enhanced or reduced nuclease activity relative to the naturally occurring nuclease. In some cases, the resulting mutated nuclease can have no nuclease activity relative to the naturally occurring nuclease.

Methods for nucleic acid-guided nuclease-mediated genome editing are provided herein. Some disclosed methods can include a two-stage construction process which relies on generation of cassette libraries that incorporate directed mutations from an editing cassettes directly into a genome, episomal nucleic acid molecule, or isolated nucleic acid molecule. In some examples, during the first stage of cassette library construction, rationally designed editing cassettes can be cotransformed into cells with a guide nucleic acid (e.g., guide RNA) that hybridizes to or targets a target DNA sequence. In some examples, the guide nucleic acid is introduced as an RNA molecule, or encoded on a DNA molecule.

Editing cassettes can be designed such that they couple deletion or mutation of a PAM site with the mutation of one or more desired codons or nucleic acid residues in the adjacent nucleic acid sequence. The deleted or mutated PAM site, in some cases, can no longer be recognized by the chosen nucleic acid-guided nuclease. In some examples, at least one PAM or more than one PAM can be deleted or mutated, such as two, three, four, or more PAMs.

Methods disclosed herein can enable generation of an entire cassette library in a single transformation. The cassette library can be retrieved, in some cases, by amplification of the recombinant chromosomes, e.g. by a PCR reaction, using a synthetic feature or priming site from the editing cassettes. In some examples, a second PAM deletion or mutation is simultaneously incorporated. This approach can covalently couple the codon-targeted mutations directly to a PAM deletion.

In some examples, there is a second stage to construction of cassette libraries. During the second stage the PCR amplified cassette libraries carrying the destination PAM deletion/mutation and the targeted mutations, such as a desired mutation of one or more nucleotides, such as one or more nucleotides in one or more codons, can be co-transformed into naive cells. The cells can be eukaryotic cell, archaeal cell, or prokaryotic cells. The cassette libraries can be co-transformed with a guide nucleic acid or plasmid encoding the same to generate a population of cells that express a rationally designed protein library. The libraries can be co-transformed with a guide nucleic acid such as a gRNA, chimeric gRNA, split gRNA, or a crRNA and trRNA set. The cassette library can comprise a plurality of cassettes wherein each cassette comprises an editing cassette and guide nucleic acid. The cassette library can comprise a plurality of cassettes wherein each cassette comprises an editing cassette, recorder cassettes and two guide nucleic acids.

In some targetable nuclease systems, the guide nucleic acid can guide selection of a target sequence. As used herein, a target sequence refers to any locus in vitro or in in vivo, or in the nucleic acid of a cell or population of cells in which a mutation of at least one nucleotide, such as a mutation of at least one nucleotide in at least one codon, is desired. The target sequence can be, for example, a genomic locus, target genomic sequence, or extrachromosomal locus. The guide nucleic acid can be expressed as a DNA molecule, referred to as a guide DNA, or as a RNA molecule, referred to as a guide RNA. A guide nucleic acid can comprise a guide sequence, that is complementary to a region of the target region. A guide nucleic acid can comprise a scaffold sequence that can interact with a compatible nucleic acid-guided nuclease, and can optionally form a secondary structure. A guide nucleic acid can functions to recruit a nucleic acid-guided nuclease to the target site. A guide sequence can be complementary to a region upstream of the target site. A guide sequence can be complementary to at least a portion of the target site. A guide sequence can be completely complementary (100% complementary) to the target site or include one or more mismatches, provided that it is sufficiently complementary to the target site to specifically hybridize/guide and recruit the nuclease. Suitable nucleic acid guided nuclease include, as non-limiting examples, CRISPR nucleases, Cas nucleases, such as Cas9 or Cpf1, MAD2, and MAD7.

In some CRISPR systems, the CRISPR RNA (crRNA or spacer-containing RNA) and trans-activating CRISPR RNA (tracrRNA or trRNA) can guide selection of a target sequence. As used herein, a target sequence refers to any locus in vitro or in in vivo, or in the nucleic acid of a cell or population of cells in which a mutation of at least one nucleotide, such as a mutation of at least one nucleotide in at least one codon, is desired. The target sequence can be, for example, a genomic locus, target genomic sequence, or extrachromosomal locus. The tracrRNA and crRNA can be expressed as a single, chimeric RNA molecule, referred to as a single-guide RNA, guide RNA, or gRNA. The nucleic acid sequence of the gRNA comprises a first nucleic acid sequence, also referred to as a first region, that is complementary to a region of the target region and a second nucleic acid sequence, also referred to a second region, that forms a stem loop structure and functions to recruit a CRISPR nuclease to the target region. The first region of the gRNA can be complementary to a region upstream of the target genomic sequence. The first region of the gRNA can be complementary to at least a portion of the target region. The first region of the gRNA can be completely complementary (100% complementary) to the target genomic sequence or include one or more mismatches, provided that it is sufficiently complementary to the target genomic sequence to specifically hybridize/guide and recruit a CRISPR nuclease, such as Cas9 or Cpf1.

A guide sequence or first region of the gRNA can be at least 15, 16, 17, 18, 19, 20, 21, 22, 23, 24, 25, 26, 27, 28, 29, or at least 30 nucleotides in length. The guide sequence or first region of the gRNA can be at least 20 nucleotides in length.

A stem loop structure that can be formed by the scaffold sequence or second nucleic acid sequence of a gRNA can be at least 50, 51, 52, 53, 54, 55, 56, 57, 58, 59, 60, 61, 62, 63, 64, 65, 66, 67, 68, 69, 70, 7, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides in length. A stem loop structure can be from 80 to 90 or 82 to 85 nucleotides in length. A scaffold sequence or second region of the gRNA that forms a stem loop structure can be 83 nucleotides in length.

A guide nucleic acid of a cassette that is introduced into a first cell using the methods disclosed herein can be the same as the guide nucleic acid of a second cassette that is introduced into a second cell. More than one guide nucleic acid can be introduced into the population of first cells and/or the population of second cells. The more than one guide nucleic acids can comprise guide sequences that are complementary to more than one target region.

Methods disclosed herein can comprise using oligonucleotides. Such oligonucleotides can be obtained or derived from many sources. For example, an oligonucleotide can be derived from a nucleic acid library that has been diversified by nonhomologous random recombination (NRR); such a library is referred to as an NRR library. An oligonucleotide can be synthesized, for example by array-based synthesis or other known chemical synthesis method. The length of an oligonucleotide can be dependent on the method used in obtaining the oligonucleotide. An oligonucleotide can be approximately 50-200 nucleotides, 75-150 nucleotides, or between 80-120 nucleotides in length. An oligonucleotide can be about 10, 20, 30, 50, 60, 70, 80, 90, 100, 110, 120, 130, 140, 150, 160, 170, 180, 190, 200, or more nucleotides in length, including any integer, for example, 51, 52, 53, 54, 201, 202, etc. An oligonucleotide can be about 100, 200, 300, 400, 500, 600, 700, 800, 900, 1000, 1250, 1500, 1750, 2000, or more nucleotides in length, including any integer, for example, 101, 203, 1001, 2001, 2010, etc.

Oligonucleotides and/or other nucleic acid molecules can be combined or assembled to generate a cassette. Such a cassette can comprise (a) a region that is homologous to a target region of the nucleic acid of the cell and includes a desired mutation of at least one nucleotide or one codon relative to the target region, and (b) a protospacer adjacent motif (PAM) mutation. The PAM mutation can be any insertion, deletion or substitution of one or more nucleotides that mutates the sequence of the PAM such that it is no longer recognized by a nucleic acid-guided nuclease system or CRISPR nuclease system. A cell that comprises such a PAM mutation may be said to be "immune" to nuclease-mediated killing. The desired mutation relative to the sequence of the target region can be an insertion, deletion, and/or substitution of one or more nucleotides. In some examples, the insertion, deletion, and/or substitution of one or more nucleotides is in at least one codon of the target region. Alternatively, the cassette can be synthesized in a single synthesis, comprising (a) a region that is homologous to a target region of the nucleic acid of the cell and includes a desired mutation of at least one nucleotide or one codon relative to the target region, (b) a protospacer adjacent motif (PAM) mutation, and optionally (c) a region that is homologous to a second target region of the nucleic acid of the cell and includes a recorder sequence.

The methods disclosed herein can be applied to any target nucleic acid molecule of interest, from any prokaryote including bacteria and archaea, or any eukaryote, including yeast, mammalian, and human genes, or any viral particle. The nucleic acid module can be a non-coding nucleic acid sequence, gene, genome, chromosome, plasmid, episomal nucleic acid molecule, artificial chromosome, synthetic chromosome, or viral nucleic acid.

Methods for assessing recovery efficiency of donor strain libraries are disclosed herein. Recovery efficiency can be verified based on the presence of a PCR product or on changes in amplicon or PCR product sizes or sequence obtained with primers directed at the selected target locus. Primers can be designed to hybridize with endogenous sequences or heterologous sequences contained on the donor nucleic acid molecule. For example, the PCR primer can be designed to hybridize to a heterologous sequence such that PCR will only be possible if the donor nucleic acid is incorporated. Sequencing of PCR products from the recovered libraries indicates the heterologous sequence or synthetic priming site from the dsDNA cassettes or donor sequences can be incorporated with about 90-100% efficiency. In other examples, the efficiency can be about 5%, 10% 20%, 30%, 40%, 50%, 60%, 70%, 75%, 80%, 85%, 90%, 95%, 99% or 100%.

In some cases, the ability to improve final editing efficiencies of the methods disclosed herein can be assessed by carrying out cassette construction in gene deficient strains before transferring to a wild-type donor strain in an effort to prevent loss of mutations during the donor construction phase. Additionally or alternatively, efficiency of the disclosed methods can be assessed by targeting an essential gene. Essential genes can include any gene required for survival or replication of a viral particle, cell, or organism. In some examples, essential genes include dxs, metA, and folA. Essential genes have been effectively targeted using guide nucleic acid design strategies described. Other suitable essential genes are well known in the art.

Provided herein are method of increasing editing efficiencies by modulating the level of a nucleic acid-guided nuclease. This could be done by using copy control plasmids, such as high copy number plasmids or low copy number plasmids. Low copy number plasmids could be plasmids that can have about 20 or less copies per cell, as opposed to high copy number plasmids that can have about 1000 copies per cell. High copy number plasmids and low copy number plasmids are well known in the art and it is understood that an exact plasmid copy per cell does not need to be known in order to characterize a plasmid as either high or low copy number.

In some cases, the decreasing expression level of a nucleic acid-guided nuclease, such as Cas9, Cpf1, MAD2, or MAD7, can increase transformation, editing, and/or recording efficiencies. In some cases, decreasing expression level of the nucleic acid-guided nuclease is done by expressing the nucleic acid-guided nuclease on a low copy number plasmid.

In some cases, the increasing expression level of a nucleic acid-guided nuclease, such as Cas9, Cpf1, MAD2, or MAD7, can increase transformation, editing, and/or recording efficiencies. In some cases, increasing expression level of the nucleic acid-guided nuclease is done by expressing the nucleic acid-guided nuclease on a high copy number plasmid.

Other methods of modulating the expression level of a protein are also envisioned and are known in the art. Such methods include using a inducible or constitutive promoter, incorporating enhancers or other expression regulatory elements onto an expression plasmid, using RNAi, amiRNAi, or other RNA silencing techniques to modulate transcript level, fusing the protein of interest to a degradation domain, or any other method known in the art.

Provided herein are methods for generating mutant libraries. In some examples, the mutant library can be effectively constructed and retrieved within 1-3 hours post recombineering. In some examples, the mutant library is constructed within 0.5, 1, 2, 3, 4, 5, 6, 7, 8, 9, 10, 12, or 24 hours post recombineering. In some examples, the mutant library can be retrieved within 0.5, 1, 2, 3, 4, 5, 6, 7, 8, 9, 10, 12, 24, 36, or 48 hours post recombineering and/or post-constructing by recombineering.

Some methods disclosed herein can be used for trackable, precision genome editing. In some examples, methods disclosed herein can achieve high efficiency editing/mutating using a single cassette that encodes both an editing cassette and guide nucleic acid, and optionally a recorder cassette and second guide nucleic acid. Alternatively, a single vector can encode an editing cassette while a guide nucleic acid is provided sequentially or concomitantly. When used with parallel DNA synthesis, such as array-based DNA synthesis, methods disclosed herein can provide single step generation of hundreds or thousands of precision edits/mutations. Mutations can be mapped by sequencing the editing cassette on the vector, rather than by sequencing of the genome or a section of the genome of the cell or organism.

The methods disclosed herein can have broad utility in protein and genome engineering applications, as well as for reconstruction of mutations, such as mutations identified in laboratory evolution experiments. In some examples, the methods and compositions disclosed here can combine an editing cassette, which could include a desired mutation and a PAM mutation, with a gene encoding a guide nucleic acid on a single vector.

In some examples, a trackable mutant library can be generated in a single transformation or single reaction.

Methods disclosed herein can comprise introducing a cassette comprising an editing cassette that includes the desired mutation and the PAM mutation into a cell or population of cells. In some embodiments, the cell into which the cassette or vector is introduced also comprises a nucleic acid-guided nuclease, such as Cas9, Cpf1, MAD2, or MAD7. In some embodiments, a gene or mRNA encoding the nucleic acid-guided nuclease is concomitantly, sequentially, or subsequently introduced into the cell or population of cells. Expression of a targetable nuclease system, including nucleic acid-guided nuclease and a guide nucleic acid, in the cell or cell population can be activated such that the guide nucleic acid recruits the nucleic acid-guided nuclease to the target region, where dsDNA cleavage occurs.

In some examples, without wishing to be bound by any particular theory, the homologous region of an editing cassette complementary to the target sequence mutates the PAM and the one or more codon of the target sequence. Cells of the population of cells that did not integrate the PAM mutation can undergo unedited cell death due to nucleic acid-guided nuclease mediated dsDNA cleavage. In some examples, cells of the population of cells that integrate the PAM mutation do not undergo cell death; they remain viable and are selectively enriched to high abundance. Viable cells can be obtained and can provide a library of trackable or targeted mutations.

In some examples, without wishing to be bound by any particular theory, the homologous region of a recorder cassette complementary to the target sequence mutates the PAM and introduces a barcode into a target sequence. Cells of the population of cells that did not integrate the PAM mutation can undergo unedited cell death due to nucleic acid-guided nuclease mediated dsDNA cleavage. In some examples, cells of the population of cells that integrate the PAM mutation do not undergo cell death; they remain viable and are selectively enriched to high abundance. Viable cells can be obtained and can provide a library of trackable mutations.

A separate vector or mRNA encoding a nucleic acid-guided nuclease can be introduced into the cell or population of cells. Introducing a vector or mRNA into a cell or population of cells can be performed using any method or technique known in the art. For example, vectors can be introduced by standard protocols, such as transformation including chemical transformation and electroporation, transduction and particle bombardment. Additionally or alternatively, mRNA can be introduced by standard protocols, such as transformation as disclosed herein, and/or by techniques involving cell permeable peptides or nanoparticles.

An editing cassette can include (a) a region, which recognizes (hybridizes to) a target region of a nucleic acid in a cell or population of cells, is homologous to the target region of the nucleic acid of the cell and includes a mutation, referred to a desired mutation, of at least one nucleotide that can be in at least one codon relative to the target region, and (b) a protospacer adjacent motif (PAM) mutation. In some examples, the editing cassette also comprises a barcode. The barcode can be a unique barcode or relatively unique such that the corresponding mutation can be identified based on the barcode. The PAM mutation may be any insertion, deletion or substitution of one or more nucleotides that mutates the sequence of the PAM such that the mutated PAM (PAM mutation) is not recognized by a chosen nucleic acid-guided nuclease system. A cell that comprises such as a PAM mutation may be said to be "immune" to nucleic acid-guided nuclease-mediated killing. The desired mutation relative to the sequence of the target region may be an insertion, deletion, and/or substitution of one or more nucleotides and may be at least one codon of the target region. In some embodiments, the distance between the PAM mutation and the desired mutation is at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, or 100 nucleotides on the editing cassette. In some embodiments, the PAM mutation is located at least 9 nucleotides from the end of the editing cassette. In some embodiments, the desired mutation is located at least 9 nucleotides from the end of the editing cassette.

A desired mutation can be an insertion of a nucleic acid sequence relative to the sequence of the target sequence. The nucleic acid sequence inserted into the target sequence can be of any length. In some embodiments, the nucleic acid sequence inserted is at least 1, 2, 3, 4, 5, 10, 20, 30, 40, 50, 100, 150, 200, 250, 300, 350, 400, 450, 500, 550, 600, 650, 700, 750, 800, 850, 900, 950, 1000, 1100, 1200, 1300, 1400, 1500, 1600, 1700, 1800, 1900, or at least 2000 nucleotides in length. In embodiments in which a nucleic acid sequence is inserted into the target sequence, the editing cassette comprises a region that is at least 10, 15, 20, 25, 30, 31, 32, 33, 34, 35, 36, 37, 38, 39, 40, 41, 42, 43, 44, 45, 46, 47, 48, 49, 50 51, 52, 53, 54, 55, 56, 57, 58, 59, or at least 60 nucleotides in length and homologous to the target sequence. The homology arms or homologous region can be about 10, 20, 30, 40, 50, 60, 70, 80, 90, 100, 110, 120, 130, 140, 150, 160, 170, 180, 190, 200, or more nucleotides in length, including any integer therein. The homology arms or homologous region can be over 200 nucleotides in length.

A barcode can be a unique barcode or relatively unique such that the corresponding mutation can be identified based on the barcode. In some examples, the barcode is a non-naturally occurring sequence that is not found in nature. In most examples, the combination of the desired mutation and the barcode within the editing cassette is non-naturally occurring and not found in nature. A barcode can be any number of nucleotides in length. A barcode can be 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more than 30 nucleotides in length. In some cases, the barcode is more than 30 nucleotides in length.

An editing cassette or recorder cassette can comprise at least a portion of a gene encoding a guide nucleic acid, and optionally a promoter operable linked to the encoded guide nucleic acid. In some embodiments, the portion of the gene encoding the guide nucleic acid encodes the portion of the guide nucleic acid that is complementary to the target sequence. The portion of the guide nucleic acid that is complementary to the target sequence, or the guide sequence, can be at least 15, 16, 17, 18, 19, 20, 21, 22, 23, 24, 25, 26, 27, 28, 29, or at least 30 nucleotides in length. In some embodiments, the guide sequence is 24 nucleotides in length. In some embodiments, the guide sequence is 18 nucleotides in length.

In some embodiments, the editing cassette or recorder cassette further comprises at least two priming sites. The priming sites may be used to amplify the cassette, for example by PCR. In some embodiments, the portion of the guide sequence is used as a priming site.

Editing cassettes or recorder cassettes for use in the described methods can be obtained or derived from many sources. For example, the cassettes can be synthesized, for example by array-based synthesis, multiplex synthesis, multi-parallel synthesis, PCR assembly, in vitro assembly, Gibson assembly, or any other synthesis method known in the art. In some embodiments, the editing cassette or recorder cassette is synthesized, for example by array-based synthesis, multiplex synthesis, multi-parallel synthesis, PCR assembly, in vitro assembly, Gibson assembly, or any other synthesis method known in the art. The length of the editing cassette or recorder cassette may be dependent on the method used in obtaining said cassette.

An editing cassette can be approximately 50-300 nucleotides, 75-200 nucleotides, or between 80-120 nucleotides in length. In some embodiments, the editing cassette can be any discrete length between 50 nucleotide and 1 Mb.

A recorder cassette can be approximately 50-300 nucleotides, 75-200 nucleotides, or between 80-120 nucleotides in length. In some embodiments, the recorder cassette can be any discrete length between 50 nucleotide and 1 Mb.

Methods disclosed herein can also involve obtaining editing cassettes and recorder cassettes and constructing a trackable plasmid or vector. Methods of constructing a vector will be known to one ordinary skill in the art and may involve ligating the cassettes into a vector backbone. In some examples, plasmid construction occurs by in vitro DNA assembly methods, oligonucleotide assembly, PCR-based assembly, SLIC, CPEC, or other assembly methods well known in the art. In some embodiments, the cassettes or a subset (pool) of the cassettes can be amplified prior to construction of the vector, for example by PCR.

The cell or population of cells comprising a polynucleotide encoding a nucleic acid-guided nuclease can be maintained or cultured under conditions in which the nuclease is expressed. Nucleic acid-guided nuclease expression can be controlled or can be constitutively on. The methods described herein can involve maintaining cells under conditions in which nuclease expression is activated, resulting in production of the nuclease, for example, Cas9, Cpf1, MAD2, or MAD7. Specific conditions under which the nucleic acid-guided nuclease is expressed can depend on factors, such as the nature of the promoter used to regulate expression of the nuclease. Nucleic acid-guided nuclease expression can be induced in the presence of an inducer molecule, such as arabinose. When the cell or population of cells comprising nucleic acid-guided nuclease encoding DNA are in the presence of the inducer molecule, expression of the nuclease can occur. CRISPR-nuclease expression can be repressed in the presence of a repressor molecule. When the cell or population of cells comprising nucleic acid-guided nuclease encoding DNA are in the absence of a molecule that represses expression of the nuclease, expression of the nuclease can occur.

Cells or the population of cells that remain viable can be obtained or separated from the cells that undergo unedited cell death as a result of nucleic acid-guided nuclease-mediated killing; this can be done, for example, by spreading the population of cells on culture surface, allowing growth of the viable cells, which are then available for assessment.

Disclosed herein are methods for the identification of the mutation without the need to sequence the genome or large portions of the genome of the cell. The methods can involve sequencing of the editing cassette, recorder cassette, or barcode to identify the mutation of one of more codon. Sequencing of the editing cassette can be performed as a component of the vector or after its separation from the vector and, optionally, amplification. Sequencing can be performed using any sequencing method known in the art, such as by Sanger sequencing or next-generation sequencing methods.

Some methods described herein can be carried out in any type of cell in which a targetable nuclease system can function, or target and cleave DNA, including prokaryotic and eukaryotic cells. In some embodiments, the cell is a bacterial cell, such as *Escherichia* spp., e.g., *E. coli*. In other embodiments, the cell is a fungal cell, such as a yeast cell, e.g., *Saccharomyces* spp. In other embodiments, the cell is an algal cell, a plant cell, an insect cell, or a mammalian cell, including a human cell.

A "vector" is any of a variety of nucleic acids that comprise a desired sequence or sequences to be delivered to or expressed in a cell. A desired sequence can be included in a vector, such as by restriction and ligation or by recombination or assembly methods know in the art. Vectors are typically composed of DNA, although RNA vectors are also available. Vectors include, but are not limited to plasmids, fosmids, phagemids, virus genomes, artificial chromosomes, and synthetic nucleic acid molecules.

Vectors useful in the methods disclosed herein can comprise at least one editing cassette as described herein, at least one gene encoding a gRNA, and optionally a promoter and/or a barcode. More than one editing cassette can be included on the vector, for example 2, 3, 4, 5, 6, 7, 8, 9, 10 or more editing cassettes. The more than one editing cassettes can be designed to target different target regions, for example, there could be different editing cassettes, each of which contains at least one region homologous with a different target region. In other examples, each editing cassette target the same target region while each editing cassette comprises a different desired mutation relative to the target region. In other examples, the plurality of editing cassettes can comprise a combination of editing cassettes targeting the same target region and editing cassettes targeting different target regions. Each editing cassette can comprise an identifying barcode. Alternatively or additionally, the vector can include one or more genes encoding more than one gRNA, e.g., 2, 3, 4, 5, 6, 7, 8, 9, 10 or more gRNAs. The more than one gRNAs can contain regions that are complementary to a portion of different target regions, for example, if there are different gRNAs, each of which can be complementary to a portion of a different target region. In other examples, the more than one gRNA can each target the same target region. In other examples, the more than one gRNA can be a combination of gRNAs targeting the same and different target regions.

A cassette comprising a gene encoding a portion of a guide nucleic acid, can be ligated or assembled into a vector that encodes another portion of a guide nucleic acid. Upon ligation or assembly, the portion of the guide nucleic acid from the cassette and the other portion of the guide nucleic acid can form a functional guide nucleic acid. A promoter and a gene encoding a guide nucleic acid can be operably linked.

In some embodiments, the methods involve introduction of a second vector encoding a nucleic acid-guided nuclease, such as Cas9, Cpf1, MAD2, or MAD7. The vector may further comprise one or more promoters operably linked to a gene encoding the nucleic acid-guided nuclease.

As used herein, "operably" linked can mean the promoter affects or regulates transcription of the DNA encoding a gene, such as the gene encoding the gRNA or the gene encoding a CRISPR nuclease.

A promoter can be a native promoter such as a promoter present in the cell into which the vector is introduced. A promoter can be an inducible or repressible promoter, for example, the promoter can be regulated allowing for inducible or repressible transcription of a gene, such as the gene encoding the guide nucleic acid or the gene encoding a nucleic acid-guided nuclease. Such promoters that are regulated by the presence or absence of a molecule can be referred to as an inducer or a repressor, respectively. The nature of the promoter needed for expression of the guide nucleic acid or nucleic acid-guided nuclease can vary based on the species or cell type and can be recognized by one of ordinary skill in the art.

A separate vector encoding a nucleic acid-guided nuclease can be introduced into a cell or population of cells before or at the same time as introduction of a trackable plasmid as disclosed herein. The gene encoding a nucleic acid-guided nuclease can be integrated into the genome of the cell or population of cells, or the gene can be maintained episomally. The nucleic acid-guided nuclease-encoding DNA can be integrated into the cellular genome before introduction of the trackable plasmid, or after introduction of the trackable plasmid. In some examples, a nucleic acid molecule, such as DNA-encoding a nucleic acid-guided nuclease, can be expressed from DNA integrated into the genome. In some embodiments, a gene encoding Cas9, Cpf1, MAD2, or MAD7 is integrated into the genome of the cell.

Vectors or cassettes useful in the methods described herein can further comprise two or more priming sites. In some embodiments, the presence of flanking priming sites allows amplification of the vector or cassette.

In some embodiments, a cassette or vector encodes a nucleic acid-guided nuclease comprising one or more nuclear localization sequences (NLSs), such as about or more than about 1, 2, 3, 4, 5, 6, 7, 8, 9, 10, or more NLSs. In some embodiments, the engineered nuclease comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g. one or more NLS at the amino-terminus and one or more NLS at the carboxy terminus). When more than one NLS is present, each may be selected independently of the others, such that a single NLS may be present in more than one copy and/or in combination with one or more other NLSs present in one or more copies. In a preferred embodiment of the invention, the engineered nuclease comprises at most 6 NLSs. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 111); the NLS from nucleoplasmin (e.g. the nucleoplasmin bipartite NLS with the sequence KRPAATKKAGQAKKKK (SEQ ID NO:112)); the c-myc NLS having the amino acid sequence PAAKRVKLD (SEQ ID NO:113) or RQRRNELKRSP (SEQ ID NO:114); the hRNPA1 M9 NLS having the sequence NQSSNFGPMKGGNFGGRSSGPYGGGGQYFAKPRNQGGY (SEQ ID NO: 115); the sequence RMRIZFKNKGKDTAELRRRRVEVSVELRKAKKDEQILKRRNV (SEQ ID NO:1 116) of the IBB domain from importin-alpha; the sequences VSRKRPRP (SEQ ID NO:117) and PPKKARED (SEQ ID NO:118) of the myoma T protein; the sequence PQPKKKPL (SEQ ID NO:119) of human p53; the sequence SALIKKKKKMAP (SEQ ID NO:120) of mouse c-abl IV; the sequences DRLRR (SEQ ID NO:121) and PKQKKRK (SEQ ID NO:122) of the influenza virus NS1; the sequence RKLKKKIKKL (SEQ ID NO:123) of the Hepatitis virus delta antigen; the sequence REKKKFLKRR (SEQ ID NO: 124) of the mouse Mx1 protein; the sequence KRKGDEVDGVDEVAKKKSKK (SEQ ID NO: 125) of the human poly(ADP-ribose) polymerase; and the sequence RKCLQAGMNLEARKTKK (SEQ ID NO: 126) of the steroid hormone receptors (human) glucocorticoid.

In general, the one or more NLSs are of sufficient strength to drive accumulation of the nucleic acid-guided nuclease in a detectable amount in the nucleus of a eukaryotic cell. In general, strength of nuclear localization activity may derive from the number of NLSs, the particular NLS(s) used, or a combination of these factors. Detection of accumulation in the nucleus may be performed by any suitable technique. For example, a detectable marker may be fused to the nucleic acid-guided nuclease, such that location within a cell may be visualized, such as in combination with a means for detecting the location of the nucleus (e.g. a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of the nucleic acid-guided nuclease complex formation (e.g. assay for DNA cleavage or mutation at the target sequence, or assay for altered gene expression activity affected by targetable nuclease complex formation and/or nucleic acid-guided nuclease activity), as compared to a control not exposed to the nucleic acid-guided nuclease or targetable nuclease complex, or exposed to a nucleic acid-guided nuclease lacking the one or more NLSs.

ProSAR

Methods disclosed herein are capable of engineering a few to hundreds of genetic sequence or proteins simultaneously. These methods can permit one to map in a single experiment many or all possible residue changes over a collection of desired proteins onto a trait of interest, as part of individual proteins of interest or as part of a pathway. This approach can be used at least for the following by mapping i) any number of residue changes for any number of proteins of interest in a specific biochemical pathway or that catalyze similar reactions or ii) any number of residues in the regulatory sites of any number of proteins or interest with a specific regulon or iii) any number of residues of a biological agent used to treat a health condition.

In some embodiments, methods described herein include identifying genetic variations of one or more target genes that affect any number or residues, such as one or more, or all residues of one or more target proteins. In accordance with these embodiments, compositions and methods disclosed herein permit parallel analysis of two or more target proteins or proteins that contribute to a trait. Parallel analysis of multiple proteins by a single experiment described can facilitate identification, modification and design of superior systems for example for producing a eukaryotic or prokaryotic byproduct, producing a eukaryotic byproduct, for example, a biological agent such as a growth factor or antibody, in a prokaryotic organism and the like. Relevant biologics used in analysis and treatment of disease can be produced in these genetically engineered environments that could reduce production time, increase quality all while reducing costs to the manufacturers and the consumers.

Some embodiments disclosed herein comprise constructs of use for studying genetic variations of a gene or gene segment wherein the gene or gene segment is capable of generating a protein. A construct can be generated for any number of residues, such as one, two, more than two, or all residue modifications of a target protein that is linked to a trackable agent such as a barcode. A barcode indicative of a genetic variation of a gene of a target protein can be located outside of the open reading frame of the gene. In some embodiments such a barcode can be located many hundreds or thousands of bases away from the gene. It is contemplated herein that these methods can be performed in vivo. In some examples, such a construct comprises a trackable polynucleic acid or plasmid as disclosed herein.

Constructs described herein can be used to compile a comprehensive library of genetic variations encompassing all residue changes of one target protein, more than one target protein or target proteins that contribute to a trait. In certain embodiments, libraries disclosed herein can be used to select proteins with improved qualities to create an improved single or multiple protein system for example for producing a byproduct, such as a chemical, biofuels, biological agent, pharmaceutical agent, or for biomass, or biologic compared to a non-selective system.

Protein Sequence-Activity Relationship (ProSAR) Mapping

Understanding the relationship between a protein's amino acid structure and its overall function continues to be of great practical, clinical, and scientific significance for biologists and engineers. Directed evolution can be a powerful engineering and discovery tool, but the random and often combinatorial nature of mutations makes their individual impacts difficult to quantify and thus challenges further engineering. More systematic analysis of contributions of individual residues or saturation mutagenesis remains labor- and time-intensive for entire proteins and simply is not possible on reasonable timescales for multiple proteins in parallel, such as metabolic pathways or multi-protein complexes, using standard methods.

Provided herein are methods which can be used to rapidly and efficiently examine the roles of some or all genes in a viral, microbial, or eukaryotic genome using mixtures of barcoded oligonucleotides. In some embodiments, these compositions and methods can be used to develop a powerful new technology for comprehensively mapping protein structure-activity relationships (ProSAR).

Using methods and compositions disclosed herein, multiplex cassette synthesis can be combined with recombineering, to create mutant libraries of specifically designed and barcoded mutations along one or more genes of interest in parallel. Screens and/or selections followed by high-throughput sequencing and/or barcode microarray methods can allow for rapid mapping of protein sequence-activity relationships (ProSAR). In some embodiments, systematic ProSAR mapping can elucidate individual amino acid mutations for improved function and/or activity and/or stability etc.

Methods can be iterated to combinatorially improve the function, activity, or stability. Cassettes can be generated by oligonucleotide synthesis. Given that existing capabilities of multiplex oligonucleotide synthesis can reach over 120,000 oligonucleotides per array, combined with recombineering, the methods disclosed herein can be scaled to construct mutant libraries for dozens to hundreds of proteins in a single experiment. In some examples, at least 1, 2, 3, 4, 5, 6, 7, 8, 9, 10, 15, 25, 50, 75, 100, 150, 200, 250, 300, 400, 500, 600, 700, 800, 900, 1000, or more proteins can be partially or completely covered by mutant libraries generated by the methods disclosed herein.

Disclosed herein are strategies to construct barcoded substitution libraries for several different proteins at the same time. Using existing multiplex DNA synthesis technology, as disclosed, a partial or complete substitution library for one or more protein constructs can be barcoded, or non-barcoded if desired, for one or for several hundred proteins at the same time. In some examples, such libraries comprise trackable plasmids as disclosed herein.

Some embodiments herein apply to analysis and structure/function/stability library construction of any protein with a corresponding screen or selection for activity. Cassette library size can depend on the number (N) of amino acids in a protein of interest, with a full saturation library, including all 20 amino acids at each position and optionally non-naturally occurring amino acids, scaling as 19 (or more)×N and an alanine-mapping library scaling as 1×N. Thus, in some examples, screening of even very large proteins of more than 1,000 amino acids can be tractable given current multiplex oligo synthesis capabilities of at least 120,000 oligos per array.

In addition or as an alternative to activity screens, more general properties with developed high-throughput screens and selections can be efficiently tested using methods and cassettes disclosed herein. For example, universal protein folding and solubility reporters can be engineered for expression in the cytoplasm, periplasm, and the inner membrane. In some examples, a protein library can be screened under different conditions such as different temperatures, different substrates or co-factors, in order to identify residue changes required for expression of various traits. In other embodiments, because residues can be analyzed one at a time, mutations at residues important for a particular trait, such as thermostability, resistance to environmental pressures, or increases or decreases in functionality or production, can be combined via multiplex recombineering with mutations important for various other traits, such as catalytic activity, to create combinatorial libraries for multi-trait optimization.

Methods disclosed herein can provide for creating and/or evaluating comprehensive, in vivo, mutational libraries of one or more target protein(s). These approaches can be extended via a recorder cassettes or barcoding technology to generate trackable mutational libraries for any number of residues or every residue in a protein. This approach can be based on protein sequence-activity relationship mapping method extended to work in vivo, capable of working on one or a few to hundreds of proteins simultaneously depending on the technology selected. For example, these methods permit one to map in a single experiment any number of, the majority of, or all possible residue changes over a collection of desired proteins onto a trait of interest, as part of individual proteins of interest or as part of a pathway.

In some examples, these approaches can be used at least for the following by mapping i) any number of or all residue changes for any number of or all proteins in a specific biochemical pathway, such as lycopene production, or that catalyze similar reactions, such as dehydrogenases or other enzymes of a pathway of use to produce a desired effect or produce a product, or ii) any number of or all residues in the regulatory sites of any number of or all proteins with a specific regulatory mechanism, such as heat shock response, or iii) any number of or all residues of a biological agent used to treat a health condition, such as insulin, a growth factor (HCG), an anti-cancer biologic, or a replacement protein for a deficient population.

Scores related to various input parameters can be assigned in order to generate one or more composite score(s) for designing genomically-engineered organisms or systems. These scores can reflect quality of genetic variations in genes or genetic loci as they relate to selection of an organism or design of an organism for a predetermined production, trait or traits. Certain organisms or systems can be designed based on a need for improved organisms for biorefining, biomass, such as crops, trees, grasses, crop residues, or forest residues, biofuel production, and using biological conversion, fermentation, chemical conversion and catalysis to generate and use compounds, biopharmaceutical production and biologic production. In certain embodiments, this can be accomplished by modulating growth or production of microorganism through genetic manipulation methods disclosed herein.

Genetic manipulation by methods disclosed herein of genes encoding a protein can be used to make desired genetic changes that can result in desired phenotypes and can be accomplished through numerous techniques including but not limited to, i) introduction of new genetic material, ii) genetic insertion, disruption or removal of existing genetic material, as well as, iii) mutation of genetic material, such as a point mutation, or any combinations of i, ii, and iii, that results in desired genetic changes with desired phenotypic changes. Mutations can be directed or random, in addition to those including, but not limited to, error prone or directed mutagenesis through PCR, mutator strains, and random mutagenesis. Mutations can be incorporated using trackable plasmids and methods as disclosed herein.

Disclosed methods can be used for inserting and accumulating higher order modifications into a microorganism's genome or a target protein; for example, multiple different site-specified mutations in the same genome, at high efficiency to generate libraries of genomes with over 1, 5, 10, 15, 20, 25, 30, 40, 50, 60, 70, 80, 90, 100, 150, 200, 250, 300, or more targeted modifications are described. In some examples, these mutations are within regulatory modules, regulatory elements, protein-coding regions, or non-coding regions. Protein coding modifications can include, but are not limited to, amino acid changes, codon optimization, and translation tuning.

In some instances, methods are provided for the co-delivery of reagents to a single biological cell. The methods generally involve the attachment or linkage of two or more cassettes, followed by delivery of the linked cassettes to a single cell. Generally, the methods provided herein involve the delivery of two or more cassettes to a single cell. In many cases, it is desirable that each individual cell receives the two or more cassettes. Traditional methods of reagent delivery may often be inefficient and/or inconsistent, leading to situations in which some cells receive only one of the cassettes. The methods provided herein may improve the efficiency and/or consistency of reagent delivery, such that a majority of cells in a cell population each receive the two or more cassettes. For example, more than 50%, 55%, 60%, 65%, 70%, 75%, 80%, 85%, 90%, 95%, 96%, 97%, 98%, 99% of the cells in a cell population may receive the two or more cassettes.

The two or more cassettes may be linked by any known method in the art and generally the method chosen will be commensurate with the chemistry of the cassettes. Generally, the two or more cassettes are linked by a covalent bond (i.e., covalently-linked), however, other types of non-covalent chemical bonds are envisioned, such as hydrogen bonds, ionic bonds, and metallic bonds. In this way, the editing cassette and the recorder cassette may be linked and delivered into a single cell. A known edit is then associated with a known recorder or barcode sequence for that cell.

In one example, the two or more cassettes are nucleic acids, such as two or more nucleic acids. The nucleic acids may be RNA, DNA, or a combination of both, and may contain any number of chemically-modified nucleotides or nucleotide analogues. In some cases, two or more RNA cassettes are linked for delivery to a single cell. In other cases, two or more DNA cassettes are linked for delivery to a single cell. In yet other cases, a DNA cassettes and an RNA cassettes are linked for delivery to a single cell. The nucleic acids may be derived from genomic RNA, complementary DNA (cDNA), or chemically or enzymatically synthesized DNA.

A cassettes may be of 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, about 110, about 120, about 130, about 140, about 150, about 160, about 170, about 180, about 190, about 200, about 210, about 220, about 230, about 240, about 250, about 275, about 300, about 325, about 350, about 375, about 400, about 425, about 450, about 475, about 500, about 525, about 550, about 575, about 600, about 625, about 650, about 675, about 700, about 725, about 750, about 775, about 800, about 825, about 850, about 875, about 900, about 925, about 950, about 975, about 1000, about 1100, about 1200, about 1300, about 1400, about 1500, about 1750, about 2000, about 2500, about 3000, about 4000, about 5000, about 6000, about 7000, about 8000, about 9000, about 10,000 or greater nucleotide residues in length, up to a full length protein encoding or regulatory genetic element.

Two or more cassettes may be linked on a linear nucleic acid molecule or may be linked on a plasmid or circular nucleic acid molecule. The two or more cassettes may be linked directly to one another or may be separated by one or more nucleotide spacers or linkers.

Two or more cassettes may be covalently linked on a linear cassettes or may be covalently linked on a plasmid or circular nucleic acid molecule. The two or more cassettes may be covalently linked directly to one another or may be separated by one or more nucleotide spacers or linkers.

Any number and variety of cassettes may be linked for co-delivery. For example, the two or more cassettes may include nucleic acids, lipids, proteins, peptides, small molecules, or any combination thereof. The two or more cassettes may be essentially any cassettes that are amenable to linkage.

In preferred examples, the two or more cassettes are covalently linked (e.g., by a chemical bond). Covalent linkage may help to ensure that the two or more cassettes are co-delivered to a single cell. Generally, the two or more cassettes are covalently linked prior to delivery to a cell. Any method of covalently linking two or more molecules may be utilized, and it should be understood that the methods used will be at least partly determined by the types of cassettes to be linked.

In some instances, methods are provided for the co-delivery of reagents to a single biological cell. The methods generally involve the covalent attachment or linkage of two or more cassettes, followed by delivery of the covalently-linked cassettes into a single cell. The methods provided may help to ensure that an individual cell receives the two or more cassettes. Any known method of reagent delivery may be utilized to deliver the linked cassettes to a cell and will at least partly depend on the chemistry of the cassettes to be delivered. Non-limiting examples of reagent delivery methods may include: transformation, lipofection, electroporation, transfection, nanoparticles, and the like.

In various embodiments, cassettes, or isolated, donor, or editing nucleic acids may be introduced to a cell or microorganism to alter or modulate an aspect of the cell or microorganism, for example survival or growth of the microorganism as disclosed herein. The isolated nucleic acid may be derived from genomic RNA, complementary DNA (cDNA), chemically or enzymatically synthesized DNA. Additionally or alternatively, isolated nucleic acids may be of use for capture probes, primers, labeled detection oligonucleotides, or fragments for DNA assembly.

A "nucleic acid" can include single-stranded and/or double-stranded molecules, as well as DNA, RNA, chemically modified nucleic acids and nucleic acid analogs. It is contemplated that a nucleic acid may be of 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, about 110, about 120, about 130, about 140, about 150, about 160, about 170, about 180, about 190, about 200, about 210, about 220, about 230, about 240, about 250, about 275, about 300, about 325, about 350, about 375, about 400, about 425, about 450, about 475, about 500, about 525, about 550, about 575, about 600, about 625, about 650, about 675, about 700, about 725, about 750, about 775, about 800, about 825, about 850, about 875, about 900, about 925, about 950, about 975, about 1000, about 1100, about 1200, about 1300, about 1400, about 1500, about 1750, about 2000, about 2500, about 3000, about 4000, about 5000, about 6000, about 7000, about 8000, about 9000, about 10,000 or greater nucleotide residues in length, up to a full length protein encoding or regulatory genetic element.

Isolated nucleic acids may be made by any method known in the art, for example using standard recombinant methods, assembly methods, synthetic techniques, or combinations thereof. In some embodiments, the nucleic acids may be cloned, amplified, assembled, or otherwise constructed.

The nucleic acids may conveniently comprise sequences in addition to a portion of a lysine riboswitch. For example, a multi-cloning site comprising one or more endonuclease restriction sites may be added. A nucleic acid may be attached to a vector, adapter, or linker for cloning of a nucleic acid. Additional sequences may be added to such cloning and sequences to optimize their function, to aid in isolation of the nucleic acid, or to improve the introduction of the nucleic acid into a cell. Use of cloning vectors, expression vectors, adapters, and linkers is well known in the art.

Isolated nucleic acids may be obtained from cellular, bacterial, or other sources using any number of cloning methodologies known in the art. In some embodiments, oligonucleotide probes which selectively hybridize, under stringent conditions, to other oligonucleotides or to the nucleic acids of an organism or cell. Methods for construction of nucleic acid libraries are known and any such known methods may be used.

Cellular genomic DNA, RNA, or cDNA may be screened for the presence of an identified genetic element of interest using a probe based upon one or more sequences. Various degrees of stringency of hybridization may be employed in the assay.

High stringency conditions for nucleic acid hybridization are well known in the art. For example, conditions may comprise low salt and/or high temperature conditions, such as provided by about 0.02 M to about 0.15 M NaCl at temperatures of about 50° C. to about 70° C. It is understood that the temperature and ionic strength of a desired stringency are determined in part by the length of the particular nucleic acid(s), the length and nucleotide content of the target sequence(s), the charge composition of the nucleic acid(s), and by the presence or concentration of formamide, tetramethylammonium chloride or other solvent(s) in a hybridization mixture. Nucleic acids may be completely complementary to a target sequence or may exhibit one or more mismatches.

Nucleic acids of interest may also be amplified using a variety of known amplification techniques. For instance, polymerase chain reaction (PCR) technology may be used to amplify target sequences directly from DNA, RNA, or cDNA. PCR and other in vitro amplification methods may also be useful, for example, to clone nucleic acid sequences, to make nucleic acids to use as probes for detecting the presence of a target nucleic acid in samples, for nucleic acid sequencing, or for other purposes.

Isolated nucleic acids may be prepared by direct chemical synthesis by methods such as the phosphotriester method, or using an automated synthesizer. Chemical synthesis generally produces a single stranded oligonucleotide. This may be converted into double stranded DNA by hybridization with a complementary sequence or by polymerization with a DNA polymerase using the single strand as a template.

Any method known in the art for identifying, isolating, purifying, using and assaying activities of target proteins contemplated herein are contemplated. Target proteins contemplated herein include protein agents used to treat a human condition or to regulate processes (e.g. part of a pathway such as an enzyme) involved in disease of a human or non-human mammal. Any method known for selection and production of antibodies or antibody fragments is also contemplated. Additionally or alternatively, target proteins can be proteins or enzymes involved in a pathway or process in a virus, cell, or organism.

Targetable Nucleic Acid Cleavage Systems

Some methods disclosed herein comprise targeting cleavage of specific nucleic acid sequences using a site-specific, targetable, and/or engineered nuclease or nuclease system. Such nucleases can create double-stranded break (DSBs) at desired locations in a genome or nucleic acid molecule. In other examples, a nuclease can create a single strand break. In some cases, two nucleases are used, each of which generates a single strand break.

The one or more double or single strand break can be repaired by natural processes of homologous recombination (HR) and non-homologous end-joining (NHEJ) using the cell's endogenous machinery. Additionally or alternatively, endogenous or heterologous recombination machinery can be used to repair the induced break or breaks.

Engineered nucleases such as zinc finger nucleases (ZFNs), Transcription Activator-Like Effector Nucleases (TALENs), engineered homing endonucleases, and RNA or DNA guided endonucleases, such as CRISPR/Cas such as Cas9 or CPF 1, and/or Argonaute systems, are particularly appropriate to carry out some of the methods of the present invention. Additionally or alternatively, RNA targeting systems can use used, such as CRISPR/Cas systems including c2c2 nucleases.

Methods disclosed herein can comprise cleaving a target nucleic acid using a CRISPR systems, such as a Type I, Type II, Type III, Type IV, Type V, or Type VI CRISPR system. CRISPR/Cas systems can be multi-protein systems or single effector protein systems. Multi-protein, or Class 1, CRISPR systems include Type I, Type III, and Type IV systems. Alternatively, Class 2 systems include a single effector molecule and include Type II, Type VI, and Type VI.

CRISPR systems used in methods disclosed herein can comprise a single or multiple effector proteins. An effector protein can comprise one or multiple nuclease domains. An effector protein can target DNA or RNA, and the DNA or RNA may be single stranded or double stranded. Effector proteins can generate double strand or single strand breaks. Effector proteins can comprise mutations in a nuclease domain thereby generating a nickase protein. Effector proteins can comprise mutations in one or more nuclease domains, thereby generating a catalytically dead nuclease that is able to bind but not cleave a target sequence. CRISPR systems can comprise a single or multiple guiding RNAs. The gRNA can comprise a crRNA. The gRNA can comprise a chimeric RNA with crRNA and tracrRNA sequences. The gRNA can comprise a separate crRNA and tracrRNA. Target nucleic acid sequences can comprise a protospacer adjacent motif (PAM) or a protospacer flanking site (PFS). The PAM or PFS may be 3' or 5' of the target or protospacer site. Cleavage of a target sequence may generate blunt ends, 3' overhangs, or 5' overhangs.

A gRNA can comprise a spacer sequence. Spacer sequences can be complementary to target sequences or protospacer sequences. Spacer sequences can be 10, 11, 12, 13, 14, 15, 16, 17, 18, 19, 20, 21, 22, 23, 24, 25, 26, 27, 28, 29, 30, 31, 32, 33, 34, 35, or 36 nucleotides in length. In some examples, the spacer sequence can be less than 10 or more than 36 nucleotides in length.

A gRNA can comprise a repeat sequence. In some cases, the repeat sequence is part of a double stranded portion of the gRNA. A repeat sequence can be 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length. In some examples, the spacer sequence can be less than 10 or more than 50 nucleotides in length.

A gRNA can comprise one or more synthetic nucleotides, non-naturally occurring nucleotides, nucleotides with a modification, deoxyribonucleotide, or any combination thereof. Additionally or alternatively, a gRNA may comprise a hairpin, linker region, single stranded region, double stranded region, or any combination thereof. Additionally or alternatively, a gRNA may comprise a signaling or reporter molecule.

A CRISPR nuclease can be endogenously or recombinantly expressed within a cell. A CRISPR nuclease can be encoded on a chromosome, extrachromosomally, or on a plasmid, synthetic chromosome, or artificial chromosome. A CRISPR nuclease can be provided or delivered to the cell as a polypeptide or mRNA encoding the polypeptide. In such examples, polypeptide or mRNA can be delivered through standard mechanisms known in the art, such as through the use of cell permeable peptides, nanoparticles, or viral particles.

gRNAs can be encoded by genetic or episomal DNA within a cell. In some examples, gRNAs can be provided or delivered to a cell expressing a CRISPR nuclease. gRNAs can be provided or delivered concomitantly with a CRISPR nuclease or sequentially. Guide RNAs can be chemically synthesized, in vitro transcribed, or otherwise generated using standard RNA generation techniques known in the art.

A CRISPR system can be a Type II CRISPR system, for example a Cas9 system. The Type II nuclease can comprise a single effector protein, which, in some cases, comprises a RuvC and HNH nuclease domains. In some cases a functional Type II nuclease can comprise two or more polypeptides, each of which comprises a nuclease domain or fragment thereof. The target nucleic acid sequences can comprise a 3' protospacer adjacent motif (PAM). In some examples, the PAM may be 5' of the target nucleic acid. Guide RNAs (gRNA) can comprise a single chimeric gRNA, which contains both crRNA and tracrRNA sequences. Alternatively, the gRNA can comprise a set of two RNAs, for example a crRNA and a tracrRNA. The Type II nuclease can generate a double strand break, which is some cases creates two blunt ends. In some cases, the Type II CRISPR nuclease is engineered to be a nickase such that the nuclease only generates a single strand break. In such cases, two distinct nucleic acid sequences can be targeted by gRNAs such that two single strand breaks are generated by the nickase. In some examples, the two single strand breaks effectively create a double strand break. In some cases where a Type II nickase is used to generate two single strand breaks, the resulting nucleic acid free ends can either be blunt, have a 3' overhang, or a 5' overhang. In some examples, a Type II nuclease may be catalytically dead such that it binds to a target sequence, but does not cleave. For example, a Type II nuclease could have mutations in both the RuvC and HNH domains, thereby rendering the both nuclease domains non-functional. A Type II CRISPR system can be one of three sub-types, namely Type II-A, Type II-B, or Type II-C.

A CRISPR system can be a Type V CRISPR system, for example a Cpf1, C2c1, or C2c3 system. The Type V nuclease can comprise a single effector protein, which in some cases comprises a single RuvC nuclease domain. In other cases, a function Type V nuclease comprises a RuvC domain split between two or more polypeptides. In such cases, the target nucleic acid sequences can comprise a 5' PAM or 3' PAM. Guide RNAs (gRNA) can comprise a single gRNA or single crRNA, such as can be the case with Cpf1. In some cases, a tracrRNA is not needed. In other examples, such as when C2c1 is used, a gRNA can comprise a single chimeric gRNA, which contains both crRNA and tracrRNA sequences or the gRNA can comprise a set of two RNAs, for example a crRNA and a tracrRNA. The Type V CRISPR nuclease can generate a double strand break, which in some cases generates a 5' overhang. In some cases, the Type V CRISPR nuclease is engineered to be a nickase such that the nuclease only generates a single strand break. In such cases, two distinct nucleic acid sequences can be targeted by gRNAs such that two single strand breaks are generated by the nickase. In some examples, the two single strand breaks effectively create a double strand break. In some cases where a Type V nickase is used to generate two single strand breaks, the resulting nucleic acid free ends can either be blunt, have a 3' overhang, or a 5' overhang. In some examples, a Type V nuclease may be catalytically dead such that it binds to a target sequence, but does not cleave. For example, a Type V nuclease could have mutations a RuvC domain, thereby rendering the nuclease domain non-functional.

A CRISPR system can be a Type VI CRISPR system, for example a C2c2 system. A Type VI nuclease can comprise a HEPN domain. In some examples, the Type VI nuclease comprises two or more polypeptides, each of which comprises a HEPN nuclease domain or fragment thereof. In such cases, the target nucleic acid sequences can by RNA, such as single stranded RNA. When using Type VI CRISPR system, a target nucleic acid can comprise a protospacer flanking site (PFS). The PFS may be 3' or 5' or the target or protospacer sequence. Guide RNAs (gRNA) can comprise a single gRNA or single crRNA. In some cases, a tracrRNA is not needed. In other examples, a gRNA can comprise a single chimeric gRNA, which contains both crRNA and tracrRNA sequences or the gRNA can comprise a set of two RNAs, for example a crRNA and a tracrRNA. In some examples, a Type VI nuclease may be catalytically dead such that it binds to a target sequence, but does not cleave. For example, a Type VI nuclease could have mutations in a HEPN domain, thereby rendering the nuclease domains non-functional.

Non-limiting examples of suitable nucleases, including nucleic acid-guided nucleases, for use in the present disclosure include C2c1, C2c2, C2c3, Cas1, Cas1B, Cas2, Cas3, Cas4, Cas5, Cas6, Cas7, Cas8, Cas9 (also known as Csn1 and Csx12), Cas10, Cpf1, Csy1, Csy2, Csy3, Cse1, Cse2, Csc1, Csc2, Csa5, Csn2, Csm2, Csm3, Csm4, Csm5, Csm6, Cmrl, Cmr3, Cmr4, Cmr5, Cmr6, Csb1, Csb2, Csb3, Csx17, Csx14, Csx100, Csx16, CsaX, Csx3, Csx1, Csx15, Csf1, Csf2, Csf3, Csf4, homologues thereof, orthologues thereof, or modified versions thereof. Suitable nucleic acid-guided nucleases can be from an organism from a genus which includes but is not limited to *Thiomicrospira, Succinivibrio, Candidatus, Porphyromonas, Acidomonococcus, Prevotella, Smithella, Moraxella, Synergistes, Francisella, Leptospira, Catenibacterium, Kandleria, Clostridium, Dorea, Coprococcus, Enterococcus, Fructobacillus, Weissella, Pediococcus, Corynebacter, Sutterella, Legionella, Treponema, Roseburia, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Alicyclobacillus, Brevibacilus, Bacillus, Bacteroidetes, Brevibacilus, Carnobacterium, Clostridiaridium, Clostridium, Desulfonatronum, Desulfovibrio, Helcococcus, Leptotrichia, Listeria, Methanomethyophilus, Methylobacterium, Opitutaceae, Paludibacter, Rhodobacter, Sphaerochaeta, Tuberibacillus,* and *Campylobacter*. Species of organism of such a genus can be as otherwise herein discussed. Suitable nucleic acid-guided nucleases can be from an organism from a genus or unclassified genus within a kingdom, which includes but is not limited to Firmicute, Actinobacteria, Bacteroidetes, Proteobacteria, Spirochates, and Tenericutes. Suitable nucleic acid-guided nucleases can be from an organism from a genus or unclassified genus within a phylum which includes but is not limited to Erysipelotrichia, Clostridia, Bacilli, Actinobacteria, Bacteroidetes, Flavobacteria, Alphaproteobacteria, Betaproteobacteria, Gammaproteobacteria, Deltaproteobacteria, Epsilonproteobacteria, Spirochaetes, and Mollicutes. Suitable nucleic acid-guided nucleases can be from an organism from a genus or unclassified genus within an order which includes but is not limited to Clostridiales, Lactobacillales, Actinomycetales, Bacteroidales, Flavobacteriales, Rhizobiales, Rhodospirillales, Burkholderiales, Neisseriales, Legionellales, Nautiliales, Campylobacterales, Spirochaetales, Mycoplasmatales, and Thiotrichales. Suitable nucleic acid-guided nucleases can be from an organism from a genus or unclassified genus within a family which includes but is not limited to *Lachnospiraceae*, Enterococcaceae, Leuconostocaceae, Lactobacillaceae, Streptococcaceae, Peptostreptococcaceae, Staphylococcaceae, Eubacteriaceae, Corynebacterineae, Bacteroidaceae, *Flavobacterium*, Cryomoorphaceae, Rhodobiaceae, Rhodospirillaceae, Acetobacteraceae, Sutterellaceae, Neisseriaceae, Legionellaceae, Nautiliaceae, Campylobacteraceae, Spirochaetaceae, Mycoplasmataceae, Pisciririckettsiaceae, and Francisellaceae.

Other nucleic acid-guided nucleases suitable for use in the methods, systems, and compositions of the present disclosure include those derived from an organism such as, but not limited to, *Thiomicrospira* sp. XS5, *Eubacterium rectale, Succinivibrio dextrinosolvens, Candidatus Methanoplasma termitum, Candidatus Methanomethylophilus alvus, Porphyromonas crevioricanis, Flavobacterium branchiophilum, Acidomonococcus* sp., *Lachnospiraceae bacterium* COE1, *Prevotella brevis* ATCC 19188, *Smithella* sp. SCADC, *Moraxella bovoculi, Synergistes jonesii, Bacteroidetes* oral taxon 274, *Francisella tularensis, Leptospira inadai* serovar Lyme str. 10, *Acidomonococcus* sp. crystal structure (5B43) *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii; Francisella tularensis* 1, *Prevotella albensis, Lachnospiraceae bacterium* MC2017 1, *Butyrivibrio proteoclasticus*, Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae bacterium* MA2020, *Candidatus Methanoplasma termitum, Eubacterium eligens, Moraxella bovoculi* 237, *Leptospira inadai, Lachnospiraceae bacterium* ND2006, *Porphyromonas crevioricanis* 3, *Prevotella disiens, Porphyromonas macacae, Catenibacterium* sp. CAG:290, *Kandleria vitulina*, Clostridiales bacterium KA00274, *Lachnospiraceae bacterium* 3-2, *Dorea longicatena, Coprococcus catus* GD/7, *Enterococcus columbae* DSM 7374, Fructobacillus sp. EFB-N1, *Weissella halotolerans, Pediococcus acidilactici, Lactobacillus curvatus, Streptococcus pyogenes, Lactobacillus versmoldensis,* and *Filifactor alocis* ATCC 35896.

Suitable nucleases for use in any of the methods disclosed herein include, but are not limited to, nucleases having the sequences listed in Table 1, or homologues having at least 10%, 15%, 20%, 25%, 30%, 35%, 40%, 45%, 50%, 55%, 60%, 65%, 70%, 75%, 80%, 85%, 90%, 95%, or 99% sequence identity to any of the nucleases listed in Table 1.

TABLE 1

| MAD nuclease | Amino acid sequence |
| --- | --- |
| MAD1 | SEQ ID NO: 1 |
| MAD2 | SEQ ID NO: 2 |
| MAD3 | SEQ ID NO: 3 |
| MAD4 | SEQ ID NO: 4 |
| MAD5 | SEQ ID NO: 5 |
| MAD6 | SEQ ID NO: 6 |
| MAD7 | SEQ ID NO: 7 |
| MAD8 | SEQ ID NO: 8 |
| MAD9 | SEQ ID NO: 9 |
| MAD10 | SEQ ID NO: 10 |
| MAD11 | SEQ ID NO: 11 |
| MAD12 | SEQ ID NO: 12 |
| MAD13 | SEQ ID NO: 13 |
| MAD14 | SEQ ID NO: 14 |
| MAD15 | SEQ ID NO: 15 |
| MAD16 | SEQ ID NO: 16 |
| MAD17 | SEQ ID NO: 17 |
| MAD18 | SEQ ID NO: 18 |
| MAD19 | SEQ ID NO: 19 |
| MAD20 | SEQ ID NO: 20 |

In some methods disclosed herein, Argonaute (Ago) systems can be used to cleave target nucleic acid sequences. Ago protein can be derived from a prokaryote, eukaryote, or archaea. The target nucleic acid may be RNA or DNA. A DNA target may be single stranded or double stranded. In some examples, the target nucleic acid does not require a specific target flanking sequence, such as a sequence equivalent to a protospacer adjacent motif or protospacer flanking sequence. The Ago protein may create a double strand break or single strand break. In some examples, when a Ago protein forms a single strand break, two Ago proteins may be used in combination to generate a double strand break. In some examples, an Ago protein comprises one, two, or more nuclease domains. In some examples, an Ago protein comprises one, two, or more catalytic domains. One or more nuclease or catalytic domains may be mutated in the Ago protein, thereby generating a nickase protein capable of generating single strand breaks. In other examples, mutations in one or more nuclease or catalytic domains of an Ago protein generates a catalytically dead Ago protein that can bind but not cleave a target nucleic acid.

Ago proteins can be targeted to target nucleic acid sequences by a guiding nucleic acid. In many examples, the guiding nucleic acid is a guide DNA (gDNA). The gDNA can have a 5' phosphorylated end. The gDNA can be single stranded or double stranded. Single stranded gDNA can be 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length. In some examples, the gDNA can be less than 10 nucleotides in length. In some examples, the gDNA can be more than 50 nucleotides in length.

Argonaute-mediated cleavage can generate blunt end, 5' overhangs, or 3' overhangs. In some examples, one or more nucleotides are removed from the target site during or following cleavage.

Argonaute protein can be endogenously or recombinantly expressed within a cell. Argonaute can be encoded on a chromosome, extrachromosomally, or on a plasmid, synthetic chromosome, or artificial chromosome. Additionally or alternatively, an Argonaute protein can be provided or delivered to the cell as a polypeptide or mRNA encoding the polypeptide. In such examples, polypeptide or mRNA can be delivered through standard mechanisms known in the art, such as through the use of cell permeable peptides, nanoparticles, or viral particles.

Guide DNAs can be provided by genetic or episomal DNA within a cell. In some examples, gDNA are reverse transcribed from RNA or mRNA within a cell. In some examples, gDNAs can be provided or delivered to a cell expressing an Ago protein. Guide DNAs can be provided or delivered concomitantly with an Ago protein or sequentially. Guide DNAs can be chemically synthesized, assembled, or otherwise generated using standard DNA generation techniques known in the art. Guide DNAs can be cleaved, released, or otherwise derived from genomic DNA, episomal DNA molecules, isolated nucleic acid molecules, or any other source of nucleic acid molecules.

In some instances, compositions are provided comprising a nuclease such as an nucleic acid-guided nuclease (e.g., Cas9, Cpf1, MAD2, or MAD7) or a DNA-guided nuclease (e.g., Ago), linked to a chromatin-remodeling enzyme. Without wishing to be bound by theory, a nuclease fusion protein as described herein may provide improved accessibility to regions of highly-structured DNA. Non-limiting examples of chromatin-remodeling enzymes that can be linked to a nucleic-acid guided nuclease may include: histone acetyl transferases (HATs), histone deacetylases (HDACs), histone methyltransferases (HMTs), chromatin remodeling complexes, and transcription activator-like (Tal) effector proteins. Histone deacetylases may include HDAC1, HDAC2, HDAC3, HDAC4, HDAC5, HDAC6, HDAC7, HDAC8, HDAC9, HDAC10, HDAC11, sirtuin 1, sirtuin 2, sirtuin 3, sirtuin 4, sirtuin 5, sirtuin 6, and sirtuin 7. Histone acetyl transferases may include GCN5, PCAF, Hat1, Elp3, Hpa2, Hpa3, ATF-2, Nut1, Esa1, Sas2, Sas3, Tip60, MOF, MOZ, MORF, HBO1, p300, CBP, SRC-1, ACTR, TIF-2, SRC-3, TAFII250, TFIIIC, Rtt109, and CLOCK. Histone methyltransferases may include ASH1L, DOT1L, EHMT1, EHMT2, EZH1, EZH2, MLL, MLL2, MLL3, MLL4, MLL5, NSD1, PRDM2, SET, SETBP1, SETD1A, SETD1B, SETD2, SETD3, SETD4, SETD5, SETD6, SETD7, SETD8, SETD9, SETDB1, SETDB2, SETMAR, SMYD1, SMYD2, SMYD3, SMYD4, SMYD5, SUV39H1, SUV39H2, SUV420H1, and SUV420H2. Chromatin-remodeling complexes may include SWI/SNF, ISWI, NuRD/Mi-2/CHD, INO80 and SWR1.

In some instances, the nuclease is a wild-type nuclease. In other instances, the nuclease is a chimeric engineered nuclease. Chimeric engineered nucleases as disclosed herein can comprise one or more fragments or domains, and the fragments or domains can be of a nuclease, such as nucleic acid-guided nuclease, orthologs of organisms of genuses, species, or other phylogenetic groups disclosed herein; advantageously the fragments are from nuclease orthologs of different species. A chimeric engineered nuclease can be comprised of fragments or domains from at least two different nucleases. A chimeric engineered nuclease can be comprised of fragments or domains from at least two different species. A chimeric engineered nuclease can be comprised of fragments or domains from at least 2, 3, 4, 5, 6, 7, 8, 9, 10, or more different nucleases or different species. In some cases, more than one fragment or domain from one nuclease or species, wherein the more than one fragment or domain are separated by fragments or domains from a second nuclease or species. In some examples, a chimeric engineered nuclease comprises 2 fragments, each from a different protein or nuclease. In some examples, a chimeric engineered nuclease comprises 3 fragments, each from a different protein or nuclease. In some examples, a chimeric engineered nuclease comprises 4 fragments, each from a different protein or nuclease. In some examples, a chimeric engineered nuclease comprises 5 fragments, each from a different protein or nuclease.

Nuclease fusion proteins can be recombinantly expressed within a cell. A nuclease fusion protein can be encoded on a chromosome, extrachromosomally, or on a plasmid, synthetic chromosome, or artificial chromosome. A nuclease and a chromatin-remodeling enzyme may be engineered separately, and then covalently linked, prior to delivery to a cell. A nuclease fusion protein can be provided or delivered to the cell as a polypeptide or mRNA encoding the polypeptide. In such examples, polypeptide or mRNA can be delivered through standard mechanisms known in the art, such as through the use of cell permeable peptides, nanoparticles, or viral particles.

Cell-Cycle-Dependent Expression of Targeted Nucleases.

In some instances, compositions comprising a cell-cycle-dependent nuclease are provided. A cell-cycle dependent nuclease generally includes a targeted nuclease as described herein linked to an enzyme that leads to degradation of the targeted nuclease during G1 phase of the cell cycle, and expression of the targeted nuclease during G2/M phase of the cell cycle. Such cell-cycle dependent expression may, for example, bias the expression of the nuclease in cells where homology-directed repair (HDR) is most active (e.g., during G2/M phase). In some cases, the nuclease is covalently linked to cell-cycle regulated protein such as one that is actively degraded during G1 phase of the cell cycle and is actively expressed during G2/M phase of the cell cycle. In a non-limiting example, the cell-cycle regulated protein is Geminin. Other non-limiting examples of cell-cycle regulated proteins may include: Cyclin A, Cyclin B, Hsl1, Cdc6, Fin1, p21 and Skp2.

In some instances, the nuclease is a wild-type nuclease.

In other instances, the nuclease is a engineered nuclease. Engineered nucleases can be non-naturally occurring.

Non-naturally occurring targetable nucleases and non-naturally occurring targetable nuclease systems can address many of these challenges and limitations.

Disclosed herein are non-naturally targetable nuclease systems. Such targetable nuclease systems are engineered to address one or more of the challenges described above and can be referred to as engineered nuclease systems. Engineered nuclease systems can comprise one or more of an engineered nuclease, such as an engineered nucleic acid-guided nuclease, an engineered guide nucleic acid, an engineered polynucleotides encoding said nuclease, or an engineered polynucleotides encoding said guide nucleic acid. Engineered nucleases, engineered guide nucleic acids, and engineered polynucleotides encoding the engineered nuclease or engineered guide nucleic acid are not naturally occurring and are not found in nature. It follows that engineered nuclease systems including one or more of these elements are non-naturally occurring.

Non-limiting examples of types of engineering that can be done to obtain a non-naturally occurring nuclease system are as follows. Engineering can include codon optimization to facilitate expression or improve expression in a host cell, such as a heterologous host cell. Engineering can reduce the size or molecular weight of the nuclease in order to facilitate expression or delivery. Engineering can alter PAM selection in order to change PAM specificity or to broaden the range of recognized PAMs. Engineering can alter, increase, or decrease stability, processivity, specificity, or efficiency of a targetable nuclease system. Engineering can alter, increase, or decrease protein stability. Engineering can alter, increase, or decrease processivity of nucleic acid scanning. Engineering can alter, increase, or decrease target sequence specificity. Engineering can alter, increase, or decrease nuclease activity. Engineering can alter, increase, or decrease editing efficiency. Engineering can alter, increase, or decrease transformation efficiency. Engineering can alter, increase, or decrease nuclease or guide nucleic acid expression.

Examples of non-naturally occurring nucleic acid sequences which are disclosed herein include sequences codon optimized for expression in bacteria, such as E. coli (e.g., SEQ ID NO: 41-60), sequences codon optimized for expression in single cell eukaryotes, such as yeast (e.g., SEQ ID NO: 127-146), sequences codon optimized for expression in multi cell eukaryotes, such as human cells (e.g., SEQ ID NO: 147-166), polynucleotides used for cloning or expression of any sequences disclosed herein (e.g., SEQ ID NO: 61-80), plasmids comprising nucleic acid sequences (e.g., SEQ ID NO: 21-40) operably linked to a heterologous promoter or nuclear localization signal or other heterologous element, proteins generated from engineered or codon optimized nucleic acid sequences (e.g., SEQ ID NO: 1-20), or engineered guide nucleic acids comprising any one of SEQ ID NO: 84-107. Such non-naturally occurring nucleic acid sequences can be amplified, cloned, assembled, synthesized, generated from synthesized oligonucleotides or dNTPs, or otherwise obtained using methods known by those skilled in the art.

Additional examples of non-naturally occurring nucleic acid sequences which are disclosed herein include sequences codon optimized for expression in bacteria, such as E. coli (e.g., SEQ ID NO: 168), sequences codon optimized for expression in single cell eukaryotes, such as yeast (e.g., SEQ ID NO: 169), sequences codon optimized for expression in multi cell eukaryotes, such as human cells (e.g., SEQ ID NO: 170), polynucleotides used for cloning or expression of any sequences disclosed herein (e.g., SEQ ID NO: 171), plasmids comprising nucleic acid sequences (e.g., SEQ ID NO: 167) operably linked to a heterologous promoter or nuclear localization signal or other heterologous element, proteins generated from engineered or codon optimized nucleic acid sequences (e.g., SEQ ID NO: 108-110), or engineered guide nucleic acids compatible with any targetable nuclease disclosed herein. Such non-naturally occurring nucleic acid sequences can be amplified, cloned, assembled, synthesized, generated from synthesized oligonucleotides or dNTPs, or otherwise obtained using methods known by those skilled in the art.

A guide nucleic acid can be DNA. A guide nucleic acid can be RNA. A guide nucleic acid can comprise both DNA and RNA. A guide nucleic acid can comprise modified of non-naturally occurring nucleotides. In cases where the guide nucleic acid comprises RNA, the RNA guide nucleic acid can be encoded by a DNA sequence on a polynucleotide molecule such as a plasmid, linear construct, or editing cassette as disclosed herein.

Nucleic acid-guided nucleases can be compatible with guide nucleic acids that are not found within the nucleases endogenous host. Such orthogonal guide nucleic acids can be determined by empirical testing. Orthogonal guide nucleic acids can come from different bacterial species or be synthetic or otherwise engineered to be non-naturally occurring.

Orthogonal guide nucleic acids that are compatible with a common nucleic acid-guided nuclease can comprise one or more common features. Common features can include sequence outside a pseudoknot region. Common features can include a pseudoknot region (e.g., 172-181). Common features can include a primary sequence or secondary structure.

A guide nucleic acid can be engineered to target a desired target sequence by altering the guide sequence such that the guide sequence is complementary to the target sequence, thereby allowing hybridization between the guide sequence and the target sequence. A guide nucleic acid with an engineered guide sequence can be referred to as an engineered guide nucleic acid. Engineered guide nucleic acids are often non-naturally occurring and are not found in nature.

In other instances, the nuclease is a chimeric nuclease. Chimeric nucleases can be engineered nucleases. Chimeric nucleases as disclosed herein can comprise one or more fragments or domains, and the fragments or domains can be of a nuclease, such as nucleic acid-guided nuclease, orthologs of organisms of genuses, species, or other phylogenetic groups; advantageously the fragments are from nuclease orthologs of different species. A chimeric nuclease can be comprised of fragments or domains from at least two different nucleases. A chimeric nuclease can be comprised of fragments or domains from at least two different species. A chimeric nuclease can be comprised of fragments or domains from at least 2, 3, 4, 5, 6, 7, 8, 9, 10, or more different nucleases or different species. In some cases, more than one fragment or domain from one nuclease or species, wherein the more than one fragment or domain are separated by fragments or domains from a second nuclease or species. In some examples, a chimeric nuclease comprises 2 fragments, each from a different protein or nuclease. In some examples, a chimeric nuclease comprises 3 fragments, each from a different protein or nuclease. In some examples, a chimeric nuclease comprises 4 fragments, each from a different protein or nuclease. In some examples, a chimeric nuclease comprises 5 fragments, each from a different protein or nuclease.

EXAMPLES

Example 1—CREATE-Plasmids and Libraries

FIGS. 1A-C depict an example of an overview of CRISPR EnAbled Trackable genome Engineering (CREATE) design and workflow. FIG. 1A shows an example of the CREATE methodology which allows programmatic genome modifications to be focused on key amino acid residues or promoter targets across the genome. Such libraries thus enable systematic assessment of sequence/activity relationships for a wide variety of genomic targets in parallel. FIG. 1B depicts an example of CREATE cassettes designed to encode both homology arm (HA) and guide RNA (gRNA) sequences to target a specific locus in the *E. coli* genome. The 100 bp homology arm was designed to introduce a specific codon mutation (target codon) that can be selectively enriched by a synonymous PAM mutation to rescue the sequence from Cas9 cleavage and allow highly efficient mutagenesis. The P1 and P2 sites (black) serve as general priming sites allowing multiplexed amplification, cloning and sequencing of many libraries in parallel. The promoter (J23119, green) is a constitutive promoter that drives expression of the gRNA. Detailed example the HA design for introducing a stop codon at residue 145 in the galK locus is also depicted at the bottom of FIG. 1B. The top sequence shows the wildtype genome sequence with the PAM (CCG; the reverse complement of which is CGG, which is recognized by *S. pyogenes* Cas9) and target codon (TAT, encoding Y) highlighted. The HA design introduces a "silent scar" at the PAM site (CgG, the reverse complement of which is CCG, which is not recognized by *S. pyogenes* Cas9) and a single nucleotide TAT>TAA mutation at codon 145 (resulting in a STOP). This design strategy was implemented programmatically for coding regions across the genome. FIG. 1C depicts an overview of an example CREATE workflow. CREATE cassettes are synthesized on a microarray delivered as large oligo pools ($10^4$ to $10^6$ individual library members). Parallel cloning and recombineering allowed processing of these pools into genomic libraries, in some cases in 23 days. Deep sequencing of the CREATE plasmids can be used to track the fitness of thousands of precision mutations genome wide following selection or screening of the mutant libraries.

Example 2—CREATE Plasmid Validation

FIG. 2A-D depicts an example of the effect of Cas9 activity on transformation and editing efficiencies. The galK 120/17 CREATE cassette (120 bp HA and 17 bp PAM/codon spacing) targeting codon 145 in galK gene or a control non-targeting gRNA vector was transformed in cells carrying pSIM5 along with dCas9 (e.g. left set of bars in FIG. 2A) or Cas9 (e.g. right set of bars in FIG. 2A) plasmids. The pSIM5 plasmid carries lambda red recombination machinery. The cas9 gene was cloned into the pBTBX-2 backbone under the control of a pBAD promoter to allow control of the cleavage activity by addition of arabinose. Transformation efficiencies of each vector are shown with dark grey bars. The total number of recombinant cells (light grey bars) were calculated based on red/white colony screening on MacConkey agar. In cases where white colonies were undetectable by plate based screening we assumed $10^4$ editing efficiencies. A $10^2$ fold reduction in transformation efficiency compared to the non-targeting gRNA control was also observed for CREATE cassettes transformed into the Cas9 background.

FIG. 2B depicts an example of the characterization of CREATE cassette HA length and PAM/codon spacing on editing efficiency. All cassettes were designed to introduce a TAA stop at codon 145 in the gene using PAMs at the indicated distance (PAM/codon bottom) from the target codon and variable homology arms lengths (HA, bottom). Dark grey and light grey bars correspond to uninduced or induced expression of Cas9 under the pBAD promoter using 0.2% arabinose. In the majority of cases the editing efficiency appears to be unaffected by induction suggesting that low amounts of Cas9 due to leaky expression are sufficient for high efficiency editing.

FIG. 2C shows example data from sequencing of the genomic loci from CREATE recombineering reactions. The galK cassettes from FIG. 2B are labeled according to the HA length and PAM codon spacing. The other loci shown were cassettes isolated from multiplexed library cloning reactions. The bar plot (FIG. 2C) indicates the number of times each genotype was observed by genomic colony sequencing following recombineering with each CREATE cassette. The + and labels at the bottom indicate the presence or absence of the designed mutation at the two relevant sites in each clone. The circular inset indicates the relative position of each gene on the *E. coli* genome.

FIG. 2D depicts an example of library coverage from multiplexed cloning of CREATE plasmids. Deep sequencing counts each variant are shown with respect to their position on the genome. The inset shows a histogram of these plasmid counts for the entire library. The distribution follows expected Poisson distribution for low average counts.

Example 3—CREATE-Recording Used to Engineer Trackable Episomal DNA Libraries

FIG. 3A depicts an example of an overview of the method used to generate a trackable episomal DNA library. Transformation of a CREATE recorder plasmid generates modifications of the target DNA at two sites. One edit occurs to the desired target gene (gray) introducing a codon or promoter mutation designed to test specific engineering objectives. The second edit targets a functionally neutral site and introduces a 15 nucleotide barcode (BC, black). By virtue of coupling these libraries on a single CREATE plasmid the target DNA is edited at both sites and each unique barcode can be used to track edits throughout the rest of the plasmid.

FIG. 2B depicts an example of the CREATE barcode design. A degenerate library is constructed from overlapping oligos and cloned in a separate site of the CREATE vector to make a library of CREATE recorder cassettes that can be coupled to the designer editing libraries.

FIG. 2C depicts an exemplary CREATE record mapping strategy. Deep sequencing of both the target DNA (left) and CREATE plasmids allows a simple sequence mapping strategy by allowing each editing cassette to be uniquely assigned by the barcode sequence. This allows the relative fitness of each barcode (and thus edit) to be tracked during selection or screening processes and can be shuttled between different organisms using standard vectors.

Example 4—CREATE-Mediated Editing of Episomal DNA

Figure 4A:
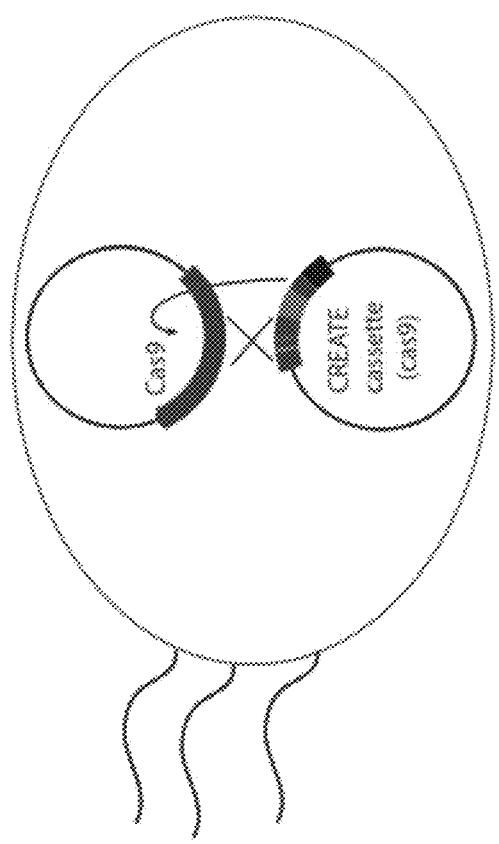

Methods and compositions disclosed herein were used to mutate a key residue of the cas9 gene used for the CREATE process (e.g. FIG. 4A-4B). A cassette was designed to make an R1335K mutation in the Cas9 protein. This cassette was cloned into a CREATE plasmid and transformed into MG1655 *E. coli* carrying the pSIM5 and X2-Cas9 vectors. The pSIM5 vector comprises lambda red recombination machinery. The X2-Cas9 vector comprises an arabinose-inducible Cas9 expression cassette. Following three hours recovery in LB supplemented with 0.4% arabinose to induce Cas9 expression, the cells were plated on agar containing antibiotics that maintain selective pressure for replication of both the X2-Cas9 and CREATE plasmids. Colony PCR of random clones revealed the designed edits from the CREATE plasmid were efficiently transferred into the X2-Cas9 plasmid (e.g. FIG. 4B). Of the clones that were sequenced, 100% contained the silent PAM mutation in X2Cas9 and 6/14 (43%) also containing desired coding edit. This is the first demonstration that plasmid based editing using CREATE is robust despite higher copy numbers associated with the plasmid target as compared to previous genome engineering efforts.

Figure 5A:
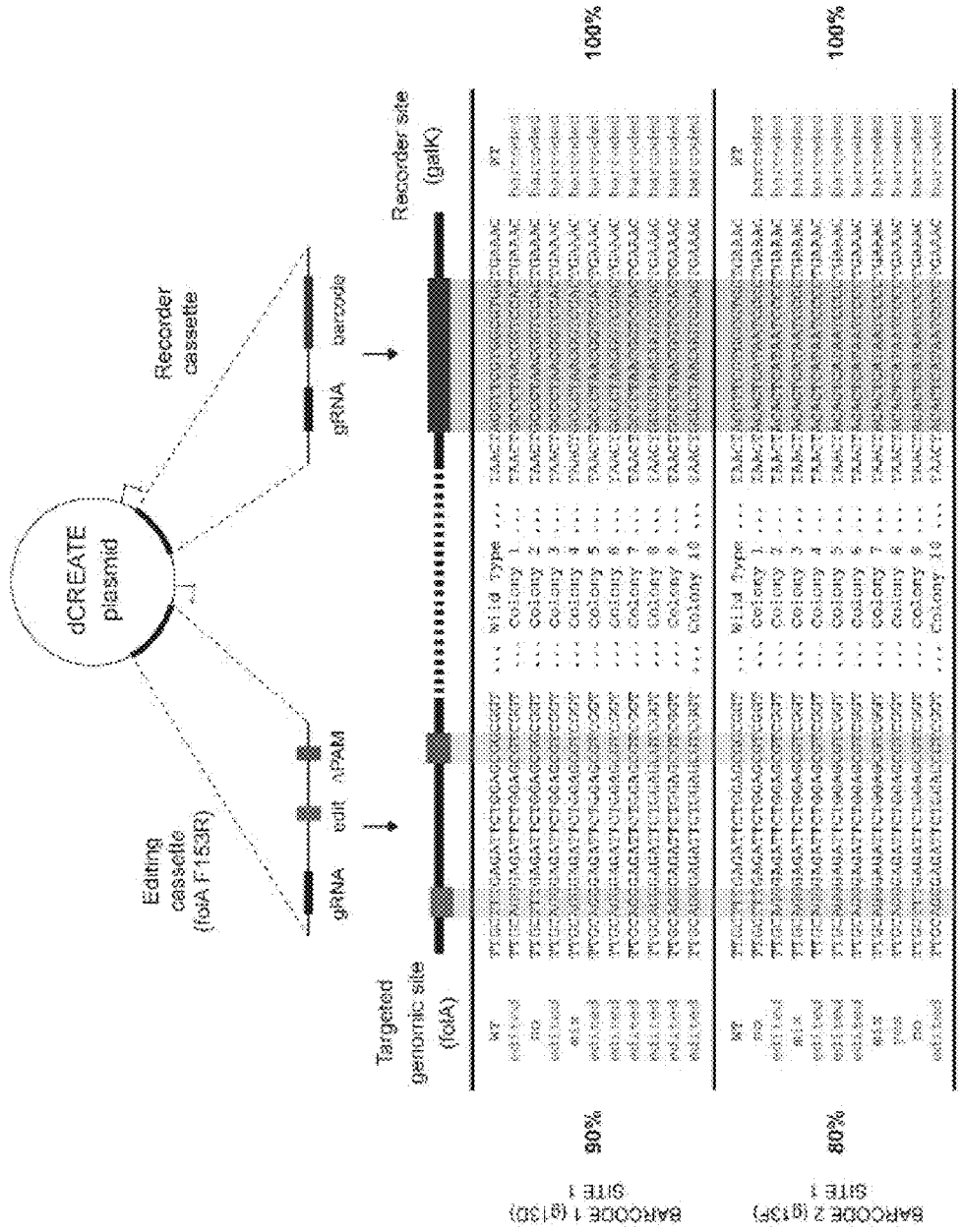
FIGS. 5A-5B depict an example of a plasmid comprising an editing cassette, designed to incorporate a target mutation and a PAM mutation into a first target sequence, and a recording cassette, designed to incorporate a barcode sequence into a second target sequence.
Figure 5B:
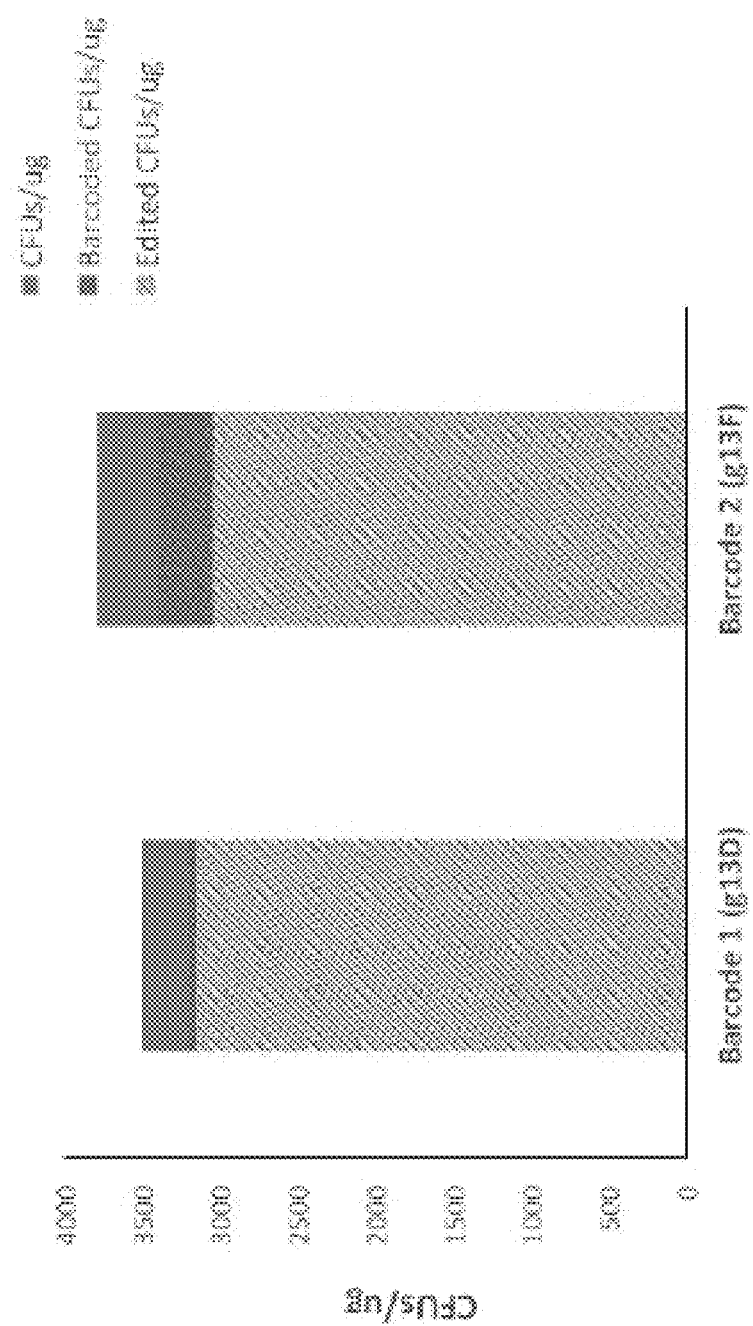

Example 5—CREATE-Mediated Editing and Tracking of E. coli Genome—Double Cassette To test the performance of the recording strategy in a genomic context we tested the ability to edit two distal genomic loci in the E. coli genome (e.g. FIG. 5A). To do so we cloned CREATE recording cassette libraries designed to embed the 15 nucleotide barcodes into the galK locus. After cloning, we isolated a few unique barcodes and cloned a second editing cassette designed to incorporate an F153R mutation in the dihydrofolate reductase (DHFR)/folA gene that was identified by our previous CREATE studies as conferring tolerance to the antibiotic trimethoprim. Genotyping of E. coli strains following transformation of the dual CREATE recording vector according to previously described protocols yielded the data in FIG. 5A. The efficiency of barcoding (100%) was higher than the target genome edit (80-90%), ensuring that edited genomes can be tracked. Of the transformed population we observed >80% of colonies contained the barcode edit in the galK locus as determined by red white colony screening (e.g. FIG. 5B). From the barcoded colonies we found that 85% of the colonies also encoded the DHFR F153R mutation indicating that we have a strong tracking between the barcode and codon edits. FIG. 5B depicts the total number of colonies (CFUs) in duplicate experiments that are edited and/or barcoded. The edited CFUs numbers were calculated by extrapolation of the data in FIG. 5A to the total number of CFUs on the plate. The barcoded CFUs numbers were calculated by counting the number of white colonies in a galK screening (site in which barcode is integrated). These data show that the majority of barcoded colonies contained the designed genomic edit.

Example 6—Plasmid Curing for Combinatorial Engineering

Figure 6:
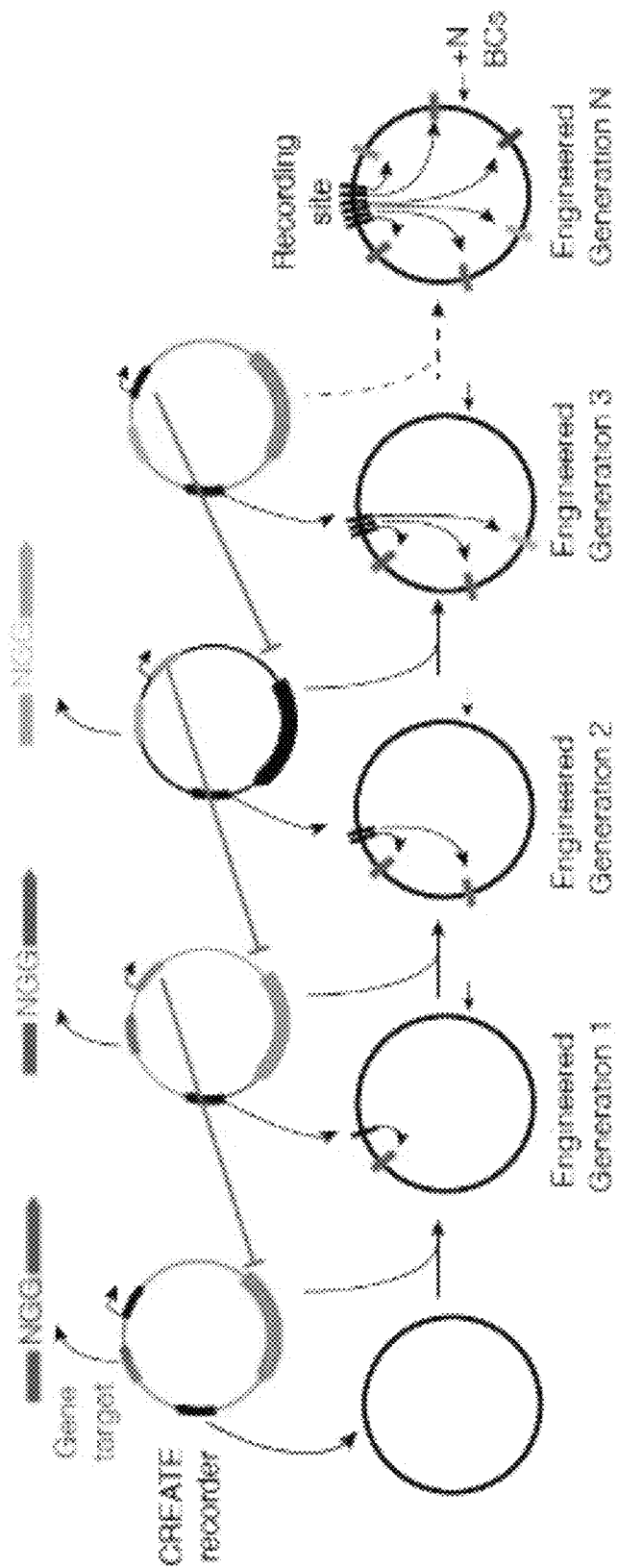
FIG. 6 depicts an example recursive engineering workflow.

FIG. 6 depicts an example of combinatorial genome engineering and tracking. Three recursive CREATE plasmids are used, each with a gRNA targeting one of the other markers in this series (indicated by T-lines). During each transformation, an edit and barcode are incorporated into the genome and the previous CREATE plasmid is cured. In this way rapid iterative transformations can be performed to construct either a defined combination of mutations or a combinatorial library to search for improved phenotypes. The recording site is compatible with short read sequencing technologies that allow the fitness of combinations to be tracked across a population. Such an approach allows rapid investigation of genetic epistasis and optimization of phenotypes relevant to basic research or for commercial biological applications.

FIG. 3D and FIG. 3E depict another example of combinatorial genome engineering. With each round of engineering, an editing cassette (blue rectangle in FIG. 3D) is incorporated into the target sequence in the genome (blue star) and a recorder cassette (green rectangle in FIG. 3D) is incorporated into a different target sequence of the genome (green dash in middle panel of FIG. 3D). In this example, each recorder sequence comprises a 15 nucleotide barcode. As shown in the right panel of FIG. 3D, the recorder sequences are each inserted adjacent to the last recorder sequence, despite where the editing cassette was inserted. Each recorder cassette can simultaneously delete a PAM site. After completion of each round of engineering, the engineered cells can be selected and then the inserted mutations can be tracked by sequencing the recorder region that comprises all of the inserted recorder cassettes. By sequencing the starting plasmid library, each editing cassette can be linked or associated with one or more unique barcodes within the recorder cassette. Since each recorder cassette corresponds to the associate editing cassette, then the mutations incorporated by the editing cassettes can be tracked or identified by the sequence of the recorder cassette, or the sequence of the barcodes within the recorder cassette. As is demonstrated in FIG. 3E, by sequencing all of the recorder cassettes or barcodes within the recorder cassettes, each of the inserted mutations can be identified and tracked. The inserted recorder sequences can be referred to as a recorder site, recorder array, or barcode array. As a result, after recursive rounds of engineering, sequencing the barcode array or recorder site allows tracking of the history of genomic editing events in the strain. When the recorder cassettes are inserted in order as depicted, for example, in FIG. 3D, then the barcode array or recorder site can identify the order in which the mutations were inserted as well as what the mutation is.

Figure 7A:
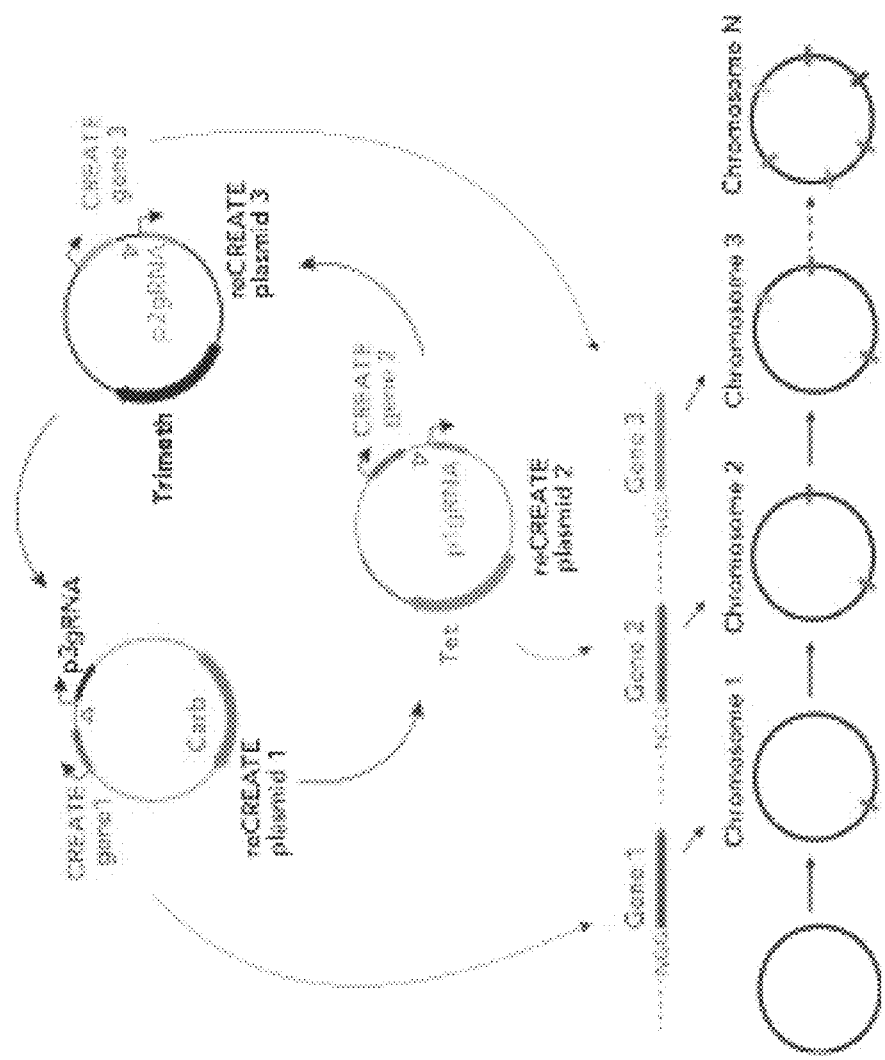

Example 7—Recursive Engineering Using Iterative CREATE-Recording Engineering Events The example of recursive engineering depicted in FIG. 7A was used for plasmid curing to demonstrate that the design is extremely efficient at eliminating previous vectors (FIG. 7B). Each CREATE plasmid can be positively selected for based on the indicated antibiotics (Trimeth: trimethoprim, Carb: carbenicillin, Tet: tetracycline) and contains a gRNA targeting one of the other antibiotic markers. For example, the reCREATE1 plasmid can be selected for on carbenicillin and encodes a gRNA that will selectively target the trimethoprim resistance gene for destruction. One pass through the carb/tetracycline/trimethoprim antibiotic marker series allows selective incorporation of up to three targeted edits. The recording function would be implemented as illustrated in FIG. 5, but is omitted here for simplicity.

FIG. 7B depicts an example of data from iterative rounds of CREATE engineering. A serial transformation series began with cells transformed with X2cas9 (kan) and the reCREATE1 vector. The spot plating results indicate that curing is 99.99% effective at each transformation step, ensuring highly efficient engineering in each round of transformation. Simultaneous genome editing and plasmid curing in each transformation step with high efficiencies was achieved by introducing the requisite recording and editing CREATE cassettes into recursive vectors as disclosed herein (e.g. FIG. 7B).

Example 8—CREATE Design and Workflow

Figure 8B:
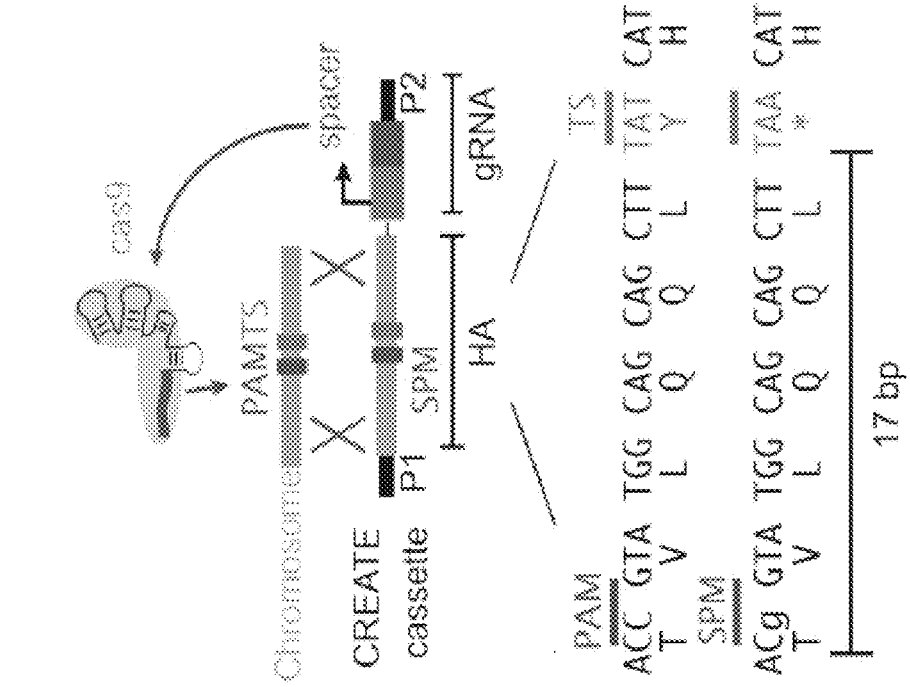
FIGS. 8A-8B depict an example genetic engineering workflow including target design, plasmid design, and plasmid library generation.
Figure 8A:
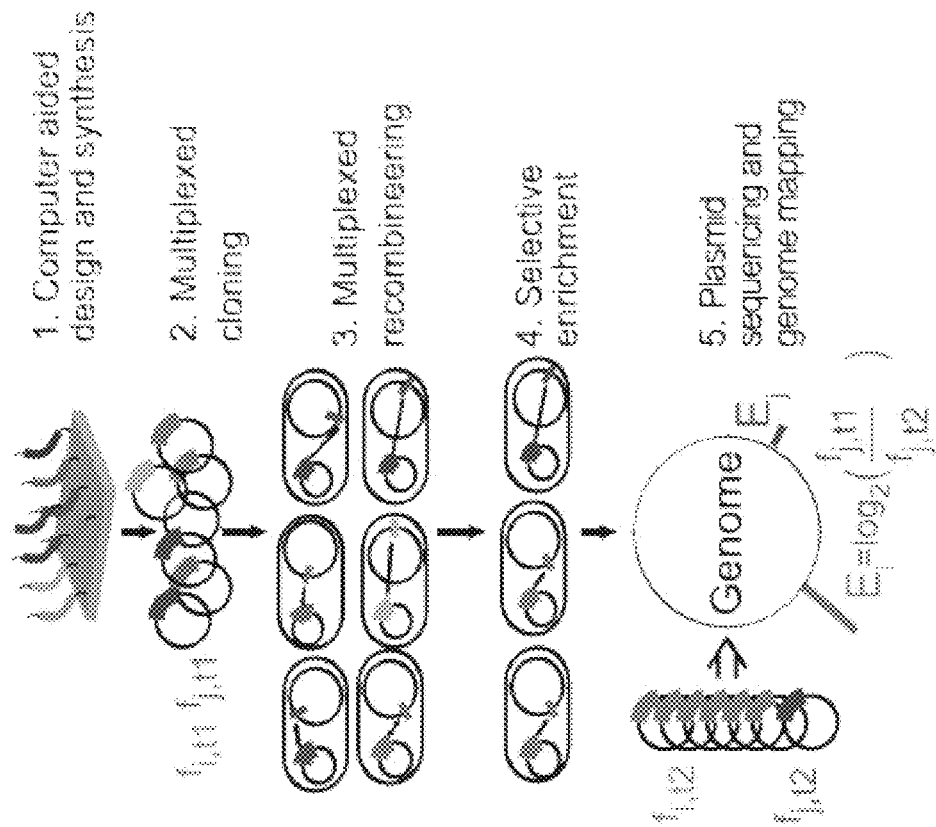

An example overview of CRISPR EnAbled Trackable genome Engineering (CREATE) design workflow is depicted in FIGS. 8A-8B. FIG. 8A shows example anatomy of a CREATE cassette designed for protein engineering. Cassettes encode a spacer (red) along with part of a guide RNA (gRNA) sequence and a designer homology arm (HA) that can template homologous recombination at the genomic cut site. For protein engineering purposes the HA is designed to systematically couple mutations to a specified codon or target site (TS, blue) to a nearby synonymous PAM mutation (SPM, red) to rescue the sequence from Cas9 cleavage and allow highly efficient mutagenesis. The priming sites (P1 and P2, black) are designed to allow multiplexed amplification and cloning of specific subpools from massively parallel array based synthesis. A constitutive promoter (green) drives expression of the gRNA. FIG. 8A further shows a detailed example of HA design for introducing a stop codon at residue 145 in the galK locus. The top sequence shows is of the wt genome with the PAM and TS codon highlighted. The translation sequences are shown to illustrate that the resulting mutant contains a single nonsynonymous mutation at the target site. FIG. 8B shows an example overview of the CREATE workflow. CREATE oligos are synthesized on a microarray and delivered as large pools ($10^4$-$10^6$ individual library members). These cassettes are amplified and cloned in multiplex with the ability to subpool designs. After introduction of the CREATE plasmids into cells expressing Cas9 mutations are transferred to the genome with high efficiencies. Measurement of the frequency of each plasmid before (fi, t1) and after selection (fi, t2) by deep sequencing provides enrichment scores (Ei) for each CREATE cassette. These scores allow rapid identification of adaptive variants at up to single nucleotide or amino acid resolution for thousands loci in parallel.

Example 9—CREATE Design Validation

FIG. 9A depicts an example of the effects of Cas9 activity on transformation and editing efficiencies were measured using no a cassette with a spacer and 120 bp HA targeted to the galK (galK_Y145*_120/17) The total transformants (TT white) produced by this CREATE vector are shown in white and the total number of recombinants (TR) in dark blue. TR is calculated as the product of the editing efficiency and Tt. Asterisks indicate experiments in which recombinants could not be observed by plate based screening. FIG. 9B shows an example of characterization of CREATE cassette HA length and PAM/codon spacing on editing efficiency. All cassettes were designed to introduce a TAA stop at codon 145 in the gene using PAMs at the indicated distance (PAM/codon bottom) from the target codon and variable homology arms lengths (HA, bottom). White and blue bars correspond to uninduced or induced expression of Cas9 under the pBAD promoter using 0.2% arabinose. In the majority of cases the editing efficiency appears to be unaffected by induction suggesting that low amounts of Cas9 due to leaky expression are sufficient for high efficiency editing. FIG. 9C depicts an example of determination of editing efficiency for oligo derived cassettes by sequencing of the genomic loci. The galK_Y145*_120/17 cassette from FIGS. 9A and 9B is shown in white for reference. The bar plot indicates the number of times each genotype was observed by genomic colony sequencing following recombineering with each CREATE cassette. The circular inset indicates the relative position of each gene on the E. coli genome. FIG. 9D depicts distance between SPM and the TS (as exemplified in FIG. 8A) is strongly correlated with editing efficiency (correct edits/total sequences sampled). The galK cassettes with 44 and 59 bp in FIG. 9B were omitted from this analysis. The depicted error bars are derived from N=3 independent replicates of the indicated experiment.

Example 10—Scanning Saturation Mutagenesis of an Essential Chromosomal Gene

FIG. 10A-10C depict an example where CREATE was used to generate a full scanning saturation mutagenesis library of the folA gene for identification of mutations that can confer resistance to TMP. The count weighted average enrichment score from two trials of selection is plotted as a function of residue position (right). Cassettes encoding nonsynonymous mutations are shown in gray, and those encoding synonymous mutations in black. Cassettes with enrichment scores greater than 1.8 are highlighted in red and mutations that affect previously reported sites are labeled for reference. The dashed lines indicate enrichment values that are significantly different ($p<0.05$) from the synonymous dataset as determined by bootstrapping of the confidence intervals. These values are shown as a histogram for reference (middle). Mutations that appear to significantly impact DHFR resistance are highlighted as red spheres to the far right. FIGS. 10D-10F depict example growth analysis of wt (left) F153W (middle) and F153R (right) variants in the indicated range of TMP concentrations (shown right).

Example 11—Reconstruction of ALE Mutation Set and Forward Engineering of Thermotolerant Genotypes FIG. 11A depicts example genomic plots of enrichment scores for CREATE libraries grown at 42.2° C. in minimal media conditions. The innermost plot illustrates the counts of the plasmid library before selection with labels for the top 20 representatives. The outer ring shows the fitness of pooled library variants after growth in minimal media at elevated temperature (42.2° C.). The bars are colored according to log 2 enrichment. Blue bars represent detrimental mutations, red bars represent significantly enriched mutations and gray bars indicate mutations that appear neutral in this assay. The 20 most enriched variants are labeled for reference and labels corresponding to ALE-derived variants are colored red. FIG. 11B shows a histogram of enrichment scores of all library variants (gray), ALE-derived mutants (red) and synonymous mutants (black) under 42.2° C. growth conditions. The dotted gray line indicates significant enrichment scores compared to the synonymous population. The histograms are normalized as a fraction of the total number of variants passing the counting threshold (number indicated in parentheses). Note that 231 of 251 unique nonsynonmous ALE cassettes sampled by this experiment appear to provide significant growth benefits. FIG. 11C depicts enrichment of mutations based on mutational distance from wt. Mutations that require 2 and 3 nucleotide (nt) transitions are exceedingly rare or absent in ALE approaches however we note that the two most enriched clones from the pooled library selection (targeting the Crp regulator) require two nucleotide substitutions and are highlighted at the far right.

Example 12—Genome Scale Mapping of Amino Acid Substitutions for the Study of Antibiotic Resistance and Tolerance FIG. 12A depicts example genomic plots of enrichment (log 2) of library variants in the presence of erythromycin (outer) and rifampicin (middle). The innermost plot illustrates the count distribution of the input plasmids for reference. Coloring and labeling are as in FIG. 11A-11C. FIG. 12B depicts CREATE mutation mapping at the individual amino acid level. CREATE cassettes that introduce bulky side chains to amino acids I572, S531 and L533 (red) of the RNA polymerase β subunit (rpoB) are highly enriched in the presence of rifampicin from genome wide targeting libraries. FIG. 11C depicts a zoomed in region of the MarA transcription factor bound to its cognate DNA target is shown for reference (PDB ID 1BL0). The wt Q89 residue protrudes away from the DNA binding interface due to unfavorable steric and electrostatic interactions between this side chain and the DNA. The Q89N substitution identified by selection introduces a H-donor and shortens the side chain such that productive H-bonding can occur between this residue and the DNA backbone. Such an interaction likely favors stronger DNA binding and induction of downstream resistance genes. FIG. 12D depicts enrichment plot of genome wide targeting libraries with 10 g/L acetate or 2 g/L furfural respectively. Coloring is the same as in FIG. 11A. FIG. 12E depicts CREATE mapping at a gene level reveals trends at the gene level. Strong enrichment fis metA and fadR targeting mutations in acetate suggests important roles for these genes in acetate tolerance, as depicted in FIG. 12F, same as in the furfural selections depicted in FIG. 12E.

Example 13—CREATE-Enabled Flexible Design Strategies

Illustration of example designs compatible with CREATE strategy are depicted in FIGS. 13A-13D. FIG. 13A shows protein engineering applications a silent codon approach is taken (top, see also FIG. 8A-8B). This mutation strategy allows targeted mutagenesis of key protein regions to alter features such as DNA binding, protein-protein interactions, catalysis, or allosteric regulation. Above an illustration of a DNA binding saturation mutagenesis library designed for the global transcription factor Fis designed for this study is illustrated. FIG. 13B shows promoter mutations PAM sites in proximity to a specified transcription start site (TSS) can be disrupted through nucleotide replacement or integration cassettes. To simplify this design procedure used in this study consensus CAP or UP elements were designed for integration at a fixed location relative to the TSS without taking into account possible effects of these mutations may have on proximal genes. FIG. 13C shows an example cassette design for mutagenizing a ribosome binding site (RBS). FIG. 13D depicts an example of a simple deletion design. Points a and b are included to illustrate distance between two sites at the gene deletion locus. In all cases cassette designs disrupt a targeted PAM to allow selective enrichment of the designed mutant.

Example 14—Engineering the Lycopene Pathway

Figure 14A:
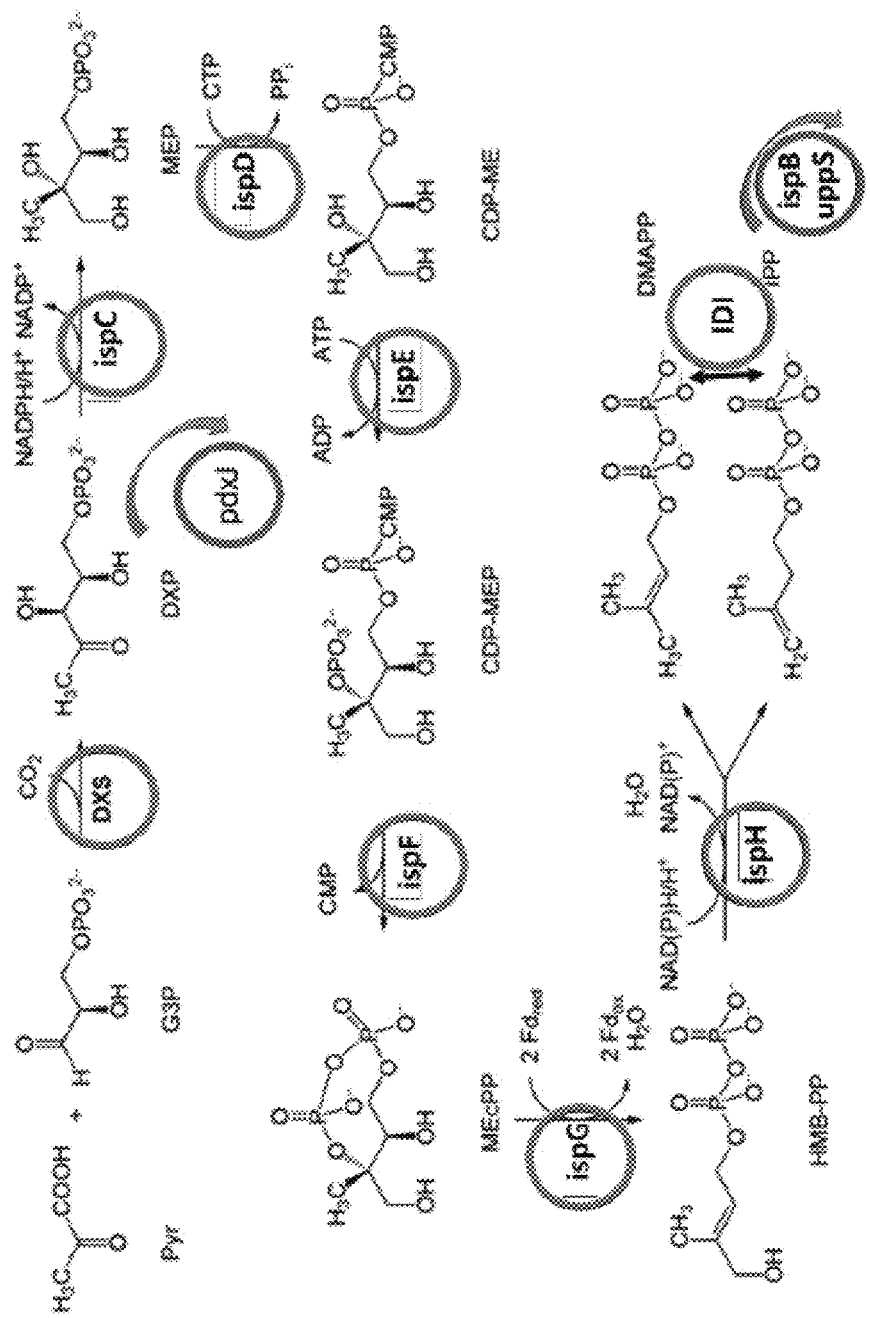
FIGS. 14A-14B depict an example design for a genetic engineering experiment.
Figure 14B:
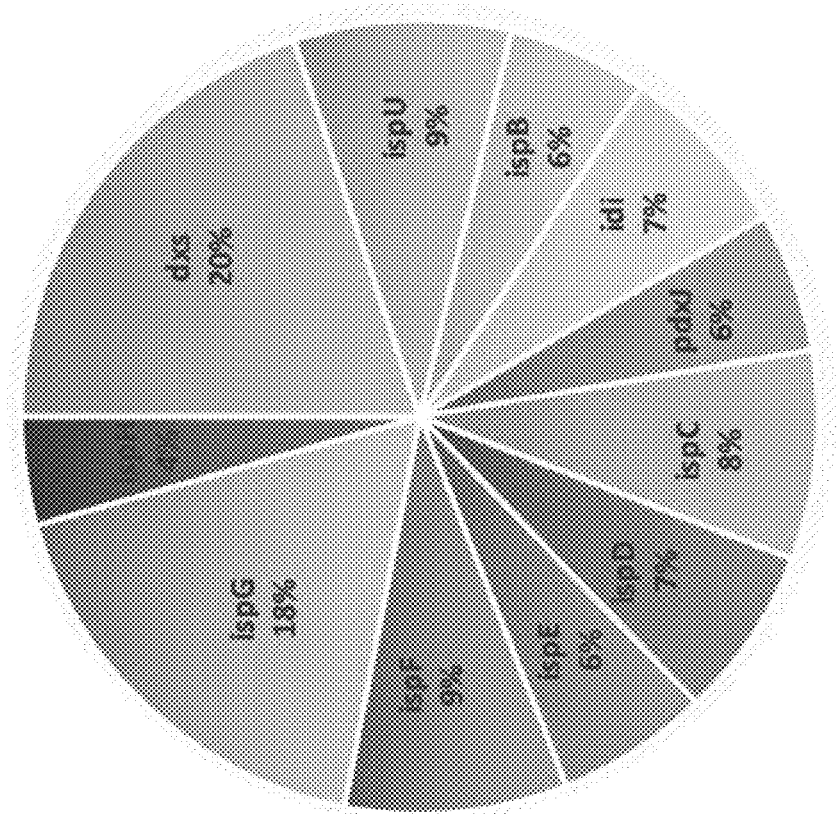

FIGS. 14A-14B depict edits made the DMAPP pathway in E. coli which is the precursor to lycopene. Edits were made to the ORF's for 11 genes. Eight edits were designed to improve activity and 3 edits were designed to reduce activity of competitive enzymes. Approximately 10,000 variants within the lycopene pathway were constructed and screened.

Example 15—Cas9 Editing Efficiency Controls

Figures 15A, 15B, 15C, 15D:
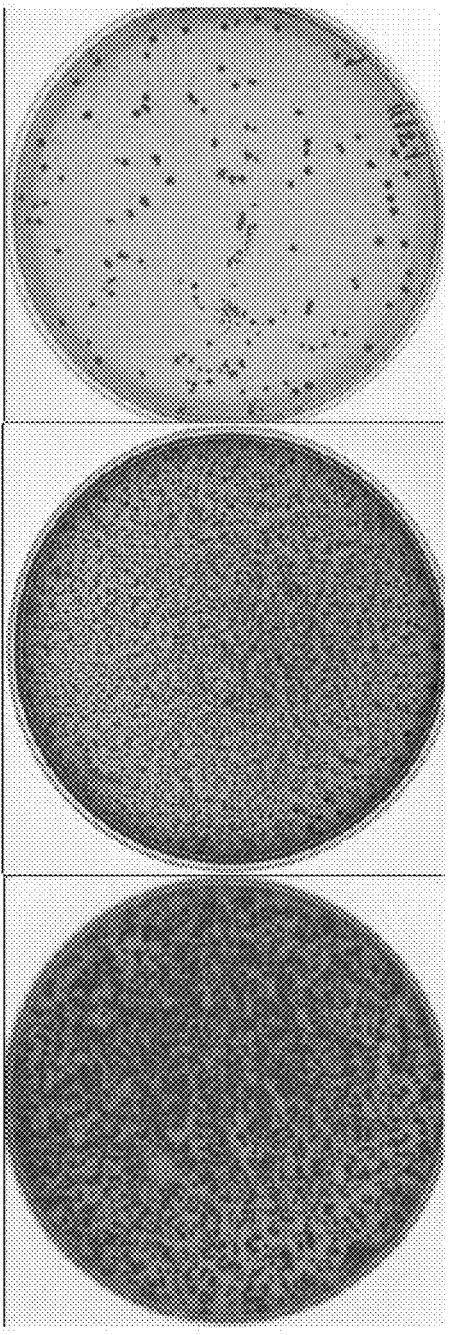
FIGS. 15A-15D depict an example of Cas9 editing efficiency controls.

FIG. 15 depicts Cas9 editing control experiments. The CREATE galK_120/17 off cassette (relevant edits shown in red at bottom) was transformed into different backgrounds to assess the efficiency of homologous recombination between the CREATE plasmid and the target genome. Red colonies represent unedited (wt) genomic variants and white colonies represent edited variants. Transformation into cells containing only pSIM5 or pSIM5/X2 and dCas9 plasmids exhibited no detectable recombination as indicated by the lack of white colonies. In the presence of active Cas9 (X2-Cas9 far right) we observe high efficiency editing (>80%), indicating the requirements for dsDNA cleavage to achieve high efficiency editing and library coverage.

Example 16—Toxicity of gRNA dsDNA Cleavage in E. coli

FIGS. 16A-16C depict experiments testing the toxicity of generating double strand breaks in E. coli. The toxicity of a single gRNA cut in E. coli as observed in control experiments with a gRNA targeting galK (spacer sequence TTAACTTTGCGTAACAACGC (SEQ ID NO: 182)) or folA (spacer sequence GTAATTTTGTATAGAATTTA (SEQ ID NO: 183)). In the absence of a repair template we observe strong killing from the gRNA. Rescue efficiencies of $10^3$-$10^4$ are observed upon co-transformation of a single stranded donor oligo indicating the need for a homologous repair template to alleviate this toxicity. b) Toxicity of multiple CREATE edits. The targeted sites are illustrated graphically on the left and at the bottom of the bar graph. A non-targeting gRNA control was used to estimate transformation efficiency based on no edits (far left, no target sites). A CREATE cassette targeting either folA (green) or galK (red) or a combination of the two. Note the multiplicative toxicity in E. coli of having additional gRNAs expressed from the same plasmid. In this scenario there is homologous repair for each site suggesting that off-target gRNA cleavage would be highly lethal. These data suggest that off target cleavage by a CREATE cassette would be selectively removed from the population early in the library construction phase.

Figure 16E:
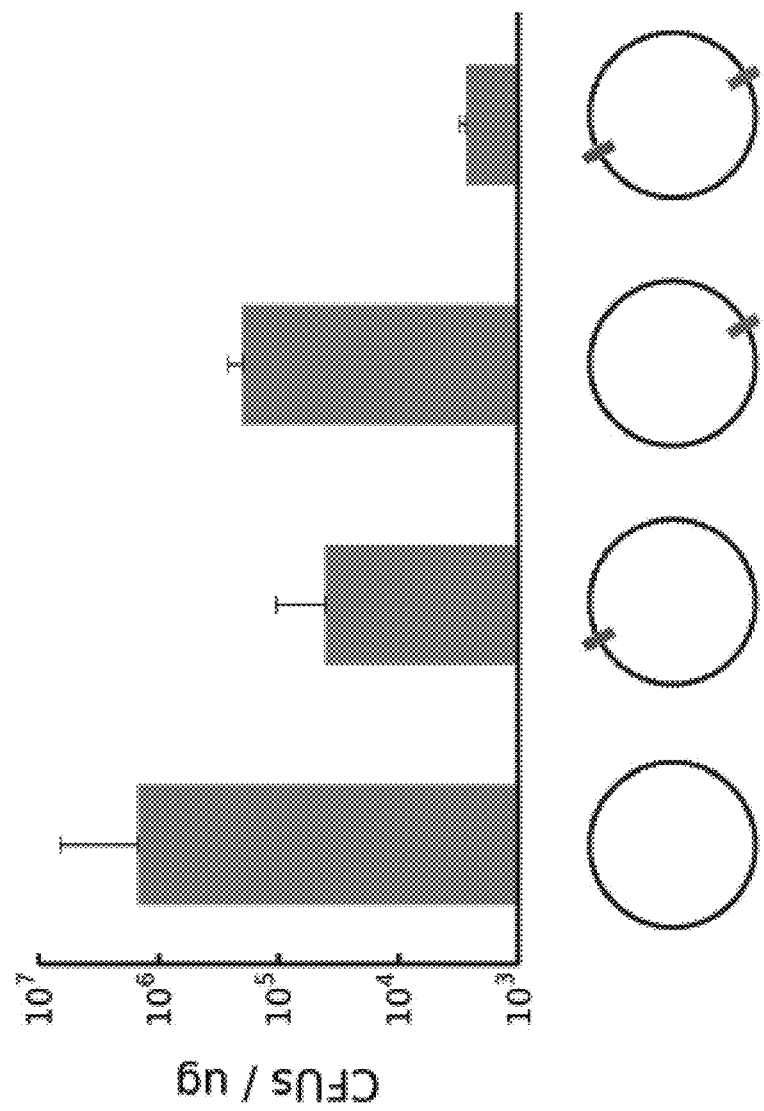
Figure 16D:
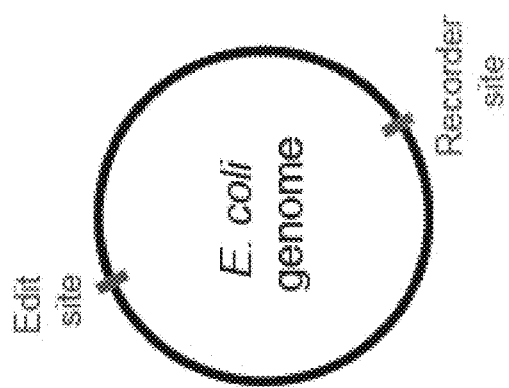

FIGS. 16D-16E depicts data from another such cell survival assay. The editing cassette contained a F153R mutation, which leads to temperature sensitivity of the folA gene. The recorder cassette contained a 15 nucleotide barcode designed to disrupt the galK gene, which allows screening of colonies on MacConkey agar plates. In this example, generating two cuts decreased cell survival compared to generating zero or one cut.

Figure 16F:
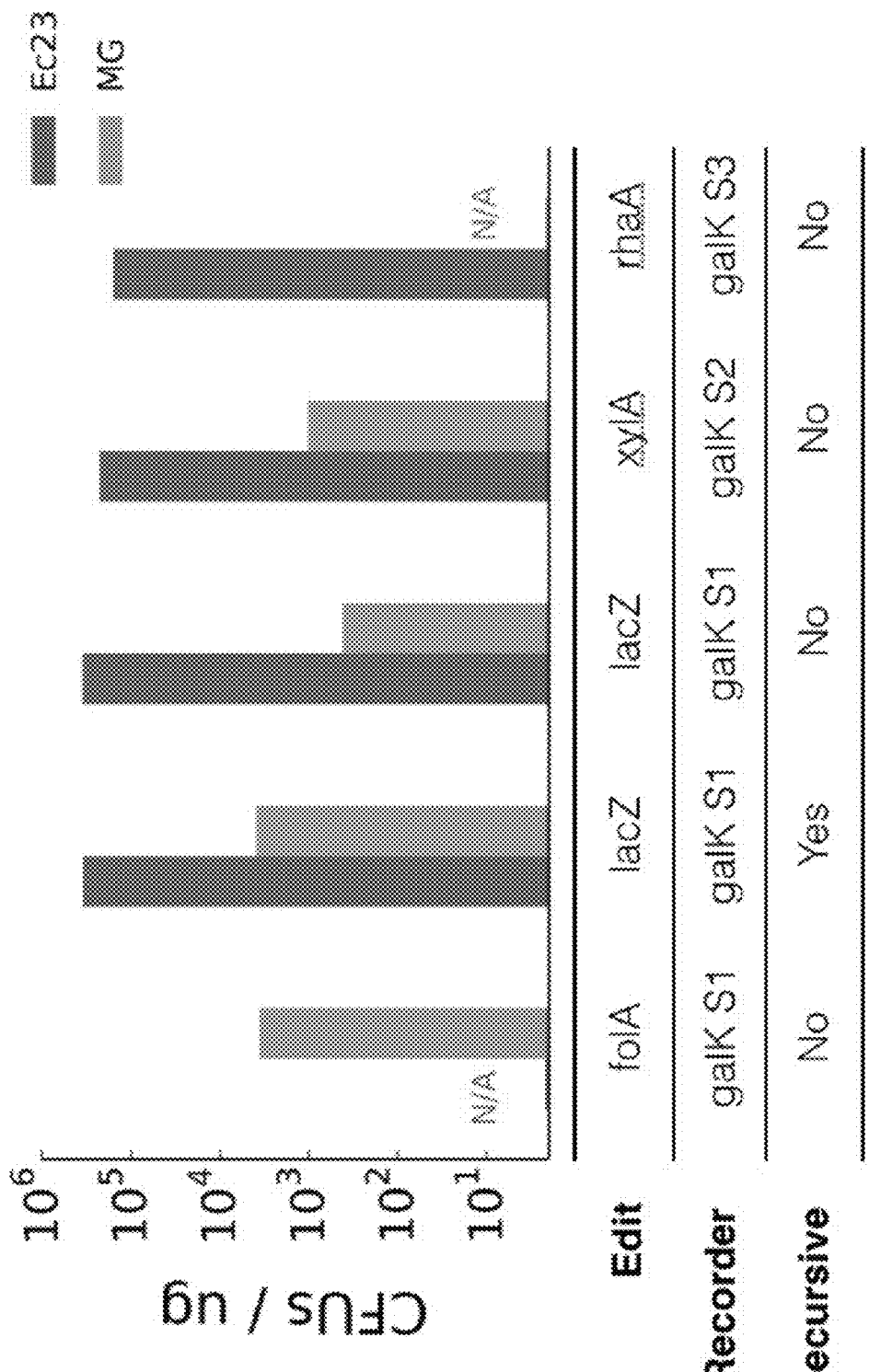
FIG. 16F-16H depict an example of a transformation and survival assay, and editing and recording efficiencies, with low and high copy plasmids expressing Cas9.

FIG. 16F depicts data from a transformation and survival assay comparing a low copy number plasmid (Ec23) expressing Cas9 and a high copy number plasmid (MG) expressing Cas9. Different vectors with distinct editing cassettes were used to target different gene target sites (folA, lacZ, xylA, and rhaA). The recorder cassettes were designed to target different sequences within the galK gene, either site S1, S2, or S3. The recursive vector used had a different vector backbone compared to the others and is part of a 3-vector system designed for iterative engineering that cures the cell of the previous round vector. The data indicates that lower Cas9 expression (Ec23 vector) increases survival and/or transformation efficiency. The decreased Cas9 expression increased transformation efficiency by orders of magnitude in cells undergoing two genomic cuts (editing cassette and recording cassette).

Figures 16G, 16H:
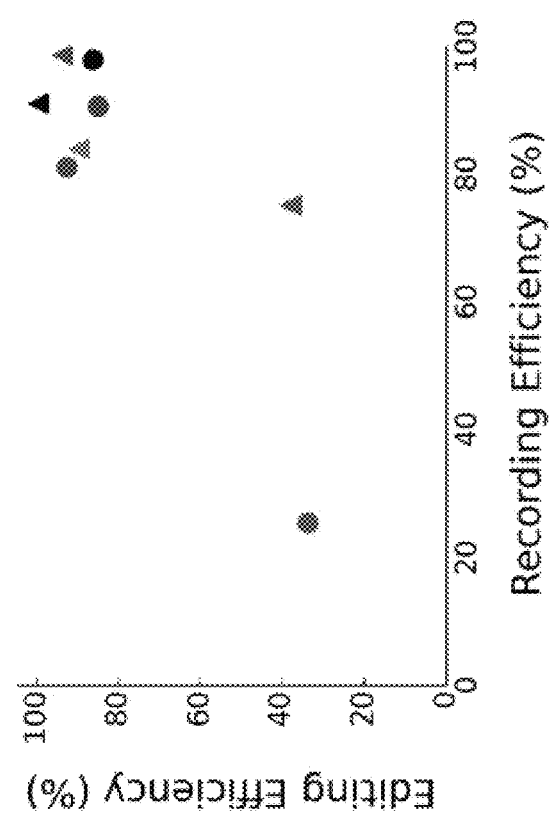

FIG. 16G shows the correlation between editing efficiency and recording efficiency in cells transformed with the low copy number plasmid (Ec23) expressing Cas9 and the high copy number plasmid (MG) expressing Cas9. Editing and recording efficiencies were similar for high (MG) and lower (Ec23) expression of cas9. Ec23 yielded more colonies and had better survival (as shown in FIG. 16E), while maintaining a high efficiency of dual editing (editing cassette and recorder cassette incorporation).

Example 17—CREATE Strategy for Gene Deletion

FIG. 17A-D depict an example CREATE strategy for gene deletion. FIG. 17A depicts an example cassette design for deleting 100 bp from the galK ORF. The HA is designed to recombine with regions of homology with the designated spacing, with each 50 bp side of the CREATE HA designed to recombine at the designated site (blue). The PAM/spacer location (red) is proximal to one of the homology arms and is deleted during recombination, allowing selectable enrichment of the deleted segment. FIG. 17B depicts electrophoresis of chromosomal PCR amplicons from clones recombineered with this cassette. FIG. 17C depicts design for 700 bp deletion as in a). FIG. 17D depicts colony PCR of 700 bp deletion cassettes as in FIG. 17B). The asterisks in FIGS. 17B and 17D indicate colonies that appear to have the designed deletion. Note that some clones appear to have bands pertaining to both wt and deletion sizes indicating that chromosome segregation in some of the colonies is incomplete when plated 3 hrs post recombineering.

Figure 18B:
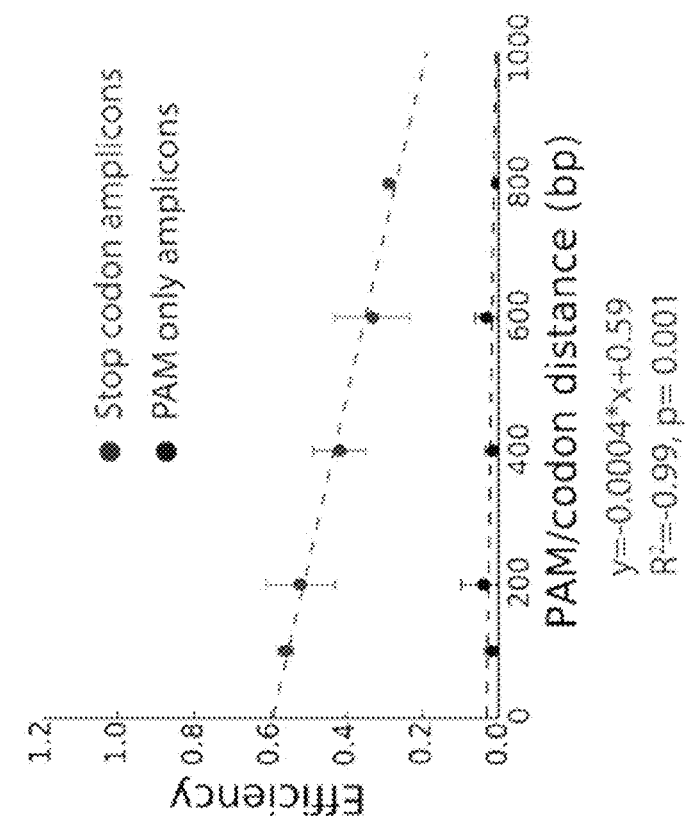
FIGS. 18A-18B depicts an example of editing efficiency controls by cotransformation of guide nucleic acid and linear dsDNA cassettes.
Figure 18A:
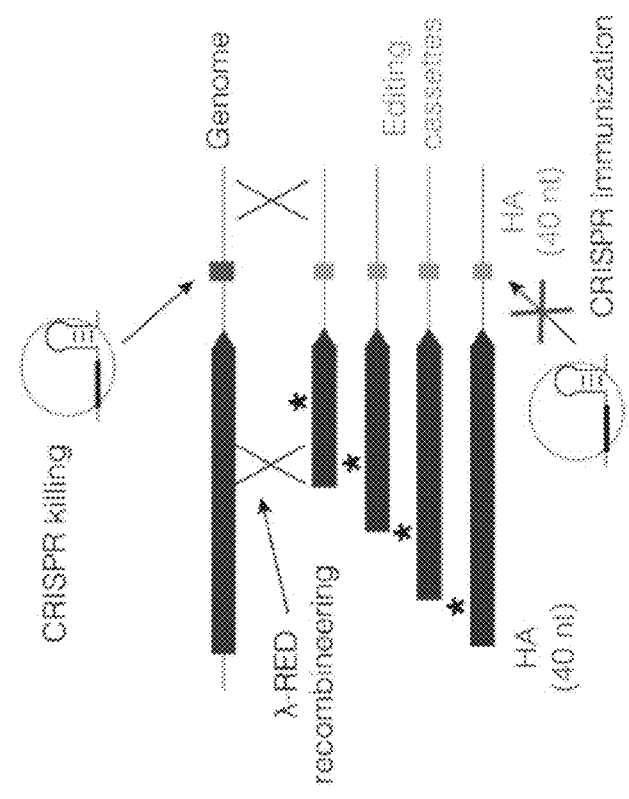

Example 18—Editing Efficiency Controls by Cotransformation of gRNA and Linear dsDNA Cassettes FIG. 18 depicts effect of PAM distance on editing efficiency using linear dsDNA PCR amplicons and co-transformation with a gRNA. On the left is an illustration of the experiments using PCR amplicons containing a dual (TAATAA) stop codon on one side (asterisk) and a PAM mutation just downstream of the galK gene (gray box) on the other end were co-transformed with a gRNA targeting the downstream galK PAM site. The primers were designed such that the mutations were 40 nt from the end of the amplicon to ensure enough homology for recombination. Data was obtained from these experiments by red/white colony screening. A linear fit to the data is shown at the bottom. Cassettes in which only the PAM mutation is present were included as assay controls were observed to have very low rates of GalK inactivation. These experiments were performed in a BW25113 strain of E. coli in which the mutS gene was knocked out to allow high efficiency editing with double stranded DNA templates. This approach in MG1655 did not achieve high efficiency editing due to the active mutS allele.

Example 19—Library Cloning Analysis and Statistics

Figure 19B:
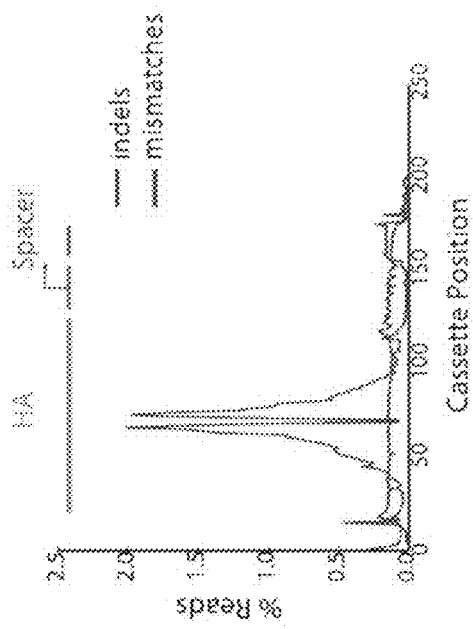
FIGS. 19A-19D depict an example of library cloning analysis and statistics.
Figure 19D:
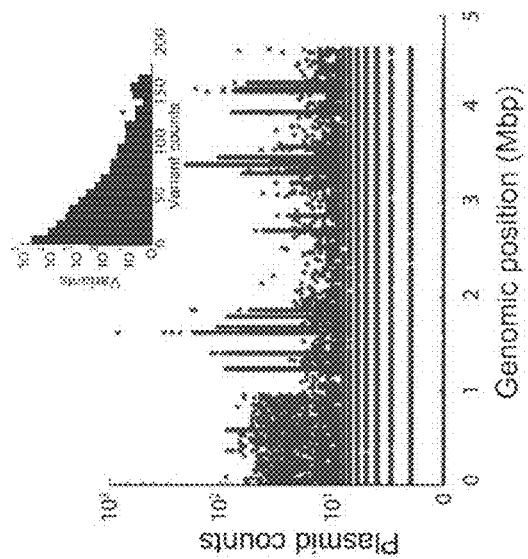
Figure 19A:
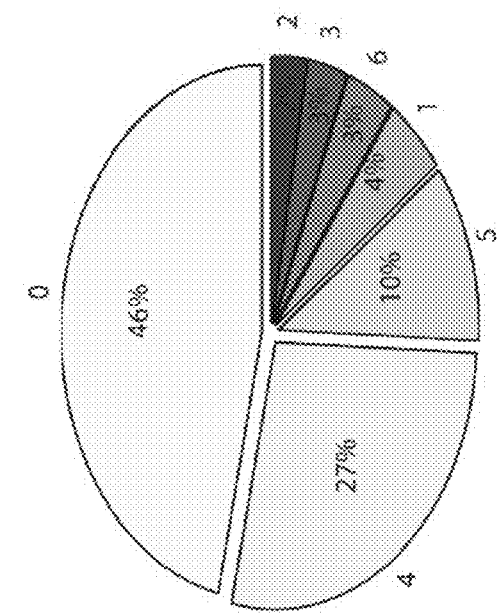
Figure 19C:
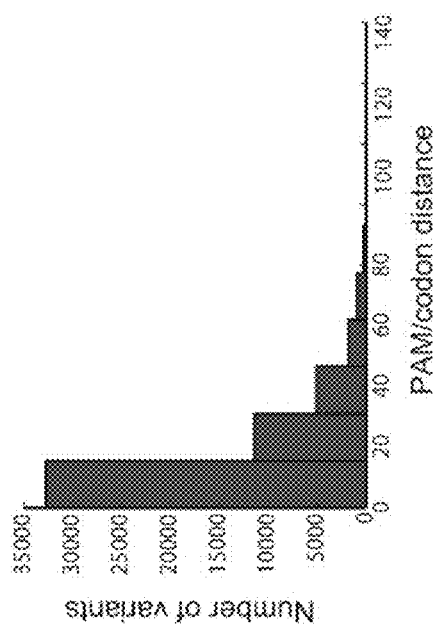

FIG. 19A depicts reads from an example plasmid library following cloning are shown according to the number of total mismatches between the read and the target design sequence. The majority of plasmids are matches to the correct design. However, there are a large number of 4 base pair indel/mismatch mutants that were observed in this cloned population. FIG. 19B depicts a plot of the mutation profile for the plasmid pool as a function of cassette position. An increase in the mutation frequency is observed near the center of the homology arm (HA) indicating a small error bias in the sequencing or synthesis of this region. We suspect that this is due to the presence of sequences complementary to the spacer element in the gRNA. FIG. 19C depicts a histogram of the distances between the PAM and codon for the CREATE cassettes designed in this study. Large majority (>95%) were within the design constraints tested in FIG. 9A-9D. The small fraction that are beyond 60 bp were made in cases where there was no synonymous PAM mutation within closer proximity. FIG. 19D depicts library coverage from multiplexed cloning of CREATE plasmids. Deep sequencing counts each variant are shown with respect to their position on the genome. The inset shows a histogram of the number of variants having the indicated plasmid counts in the cloned libraries.

Example 20—Precision of CREATE Cassette Tracking of Recombineered Populations

Figure 20B:
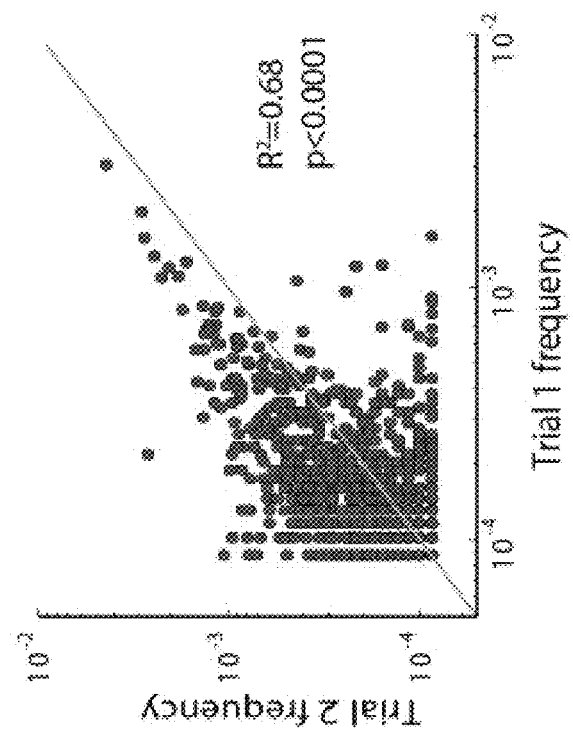
FIGS. 20A-20B depict an example of precision of editing cassette tracking of recombineered populations.
Figure 20A:
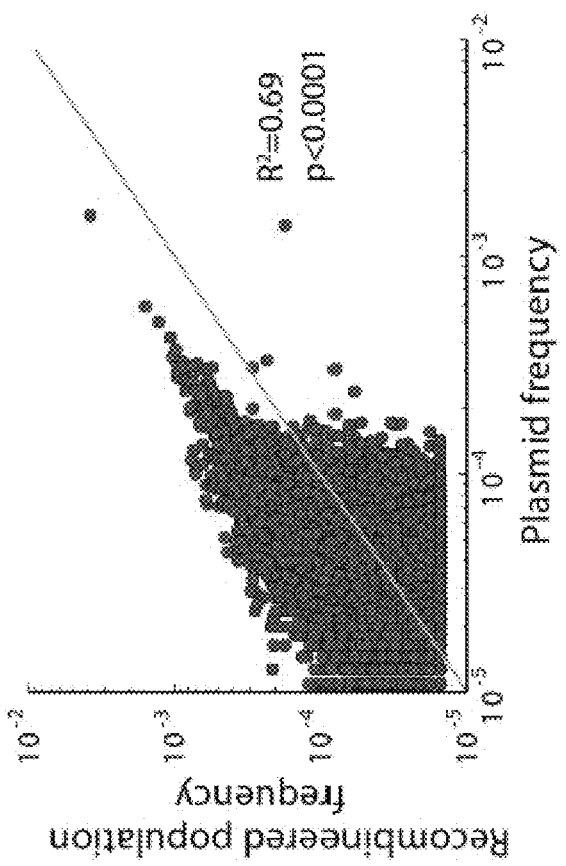

FIG. 20A depicts a correlation plot of CREATE cassette read frequencies in the plasmid population prior to Cas9 exposure (x-axis) and after 3 hours post transformation into a Cas9 background. FIG. 20B depicts a correlation plot between replicate recombineering reactions following overnight recovery. The gray lines indicate the line of perfect correlation for reference. R2 and p values were calculated from a linear fit to the data using the Python SciPy statistics package. A counting threshold of 5 for each replicate experiment was applied to the data to filter out noise from each data set.

Example 21—Growth Characteristics of folA Mutations in M9 Minimal Media

Figure 21:
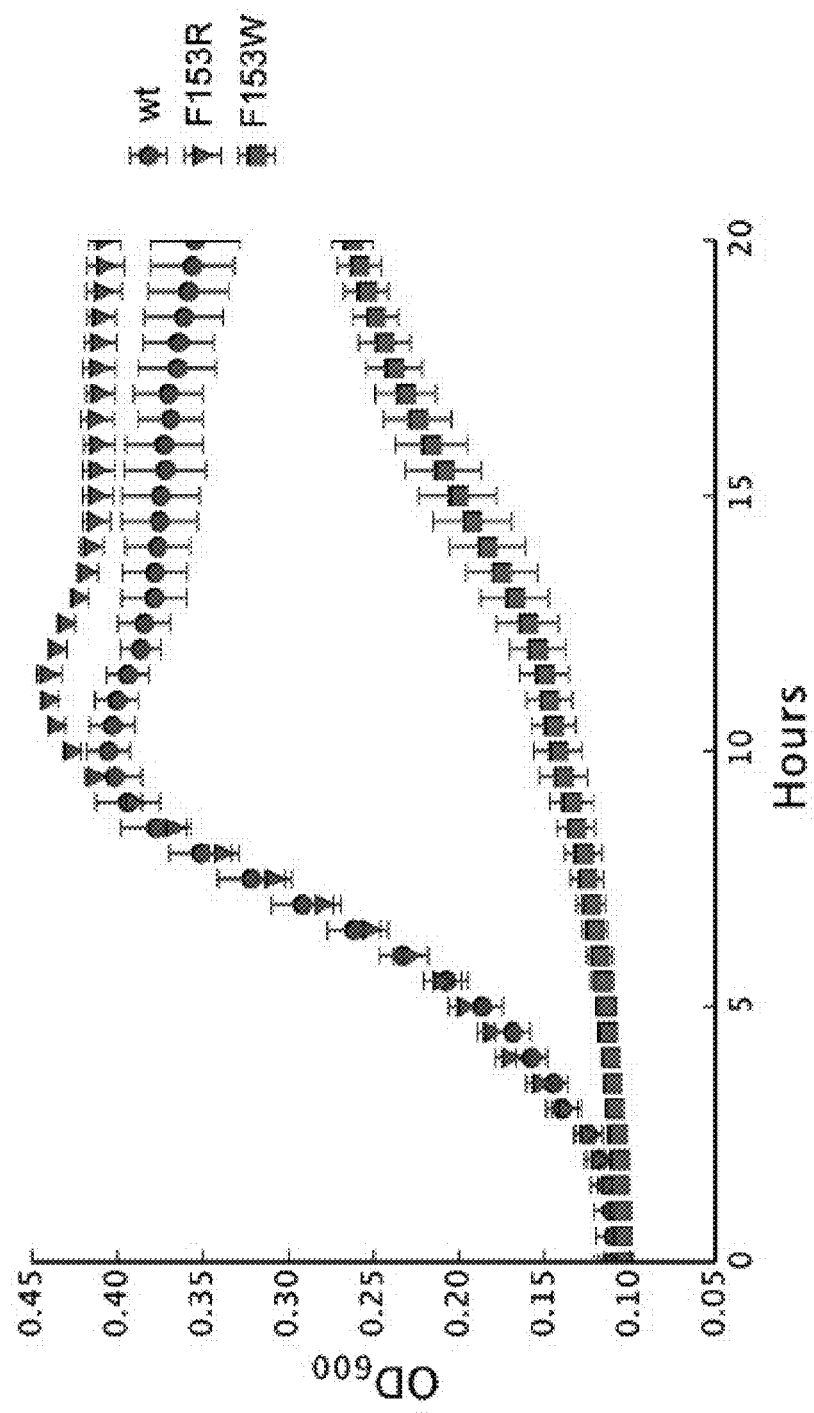
FIG. 21 depicts an example of growth characteristics of folA mutations in M9 minimal media

FIG. 21 depicts growth characteristics of folA mutations in M9 minimal media. While F153R appears to maintain normal growth characteristics the growth rate of the F153W mutation is significantly slower under these conditions, suggesting that these two amino acid substitutions at the same site have very different effects on organismal fitness presumably due to different changes invoked in the stability/dynamics of this protein.

Example 22—Enrichment Profiles for folA CREATE Cassettes in Minimal Media

FIG. 22 depicts enrichment profiles for folA CREATE cassettes in minimal media. Cassettes that encode synonymous HA are shown in black and non-synonymous cassettes in gray, the dashed lines indicate enrichment scores with p<0.05 significance compared to the synonymous population mean as estimated from a bootstrap analysis. The enrichment score observed for each mutant cassette at each position in the protein sequence is shown to the left and a histogram of these enrichment scores as a fraction of the total variants to the right. The two populations appear to be largely similar. Conserved residues that are highly deleterious are shown in blue for reference.

Figure 23B:
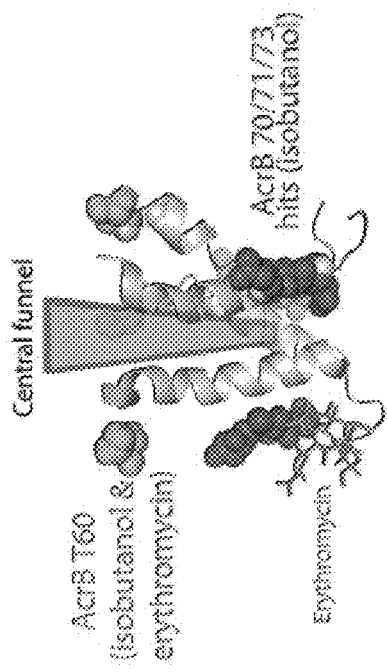
Figure 23C:
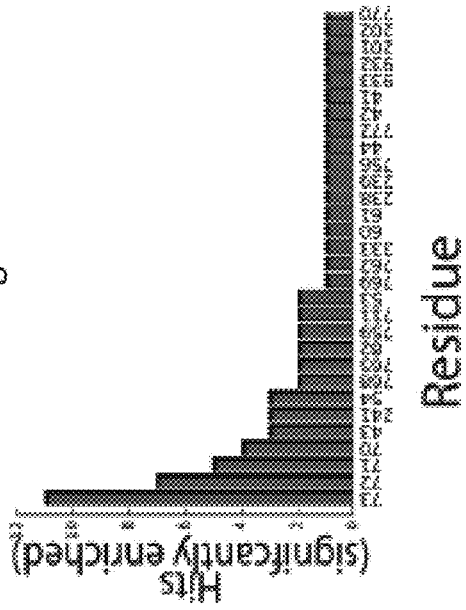
Figure 23A:
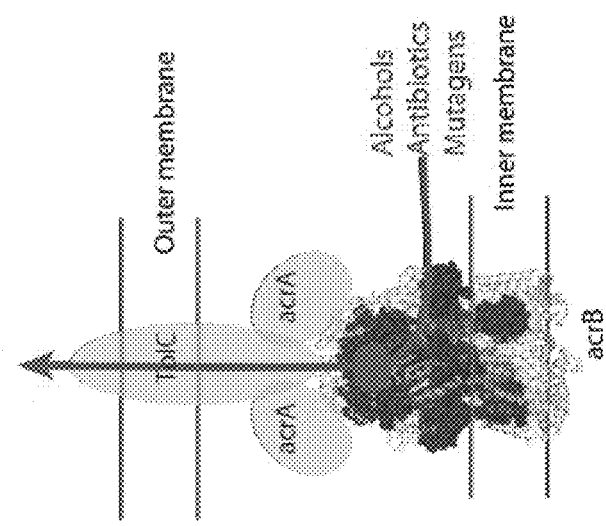

Example 23—Validation of Newly Identified acrB Mutations for Improved Solvent and Antibiotic Tolerance FIG. 23A depicts on the left a global overview of AcrB efflux pump. Substrates enter the pump through the openings in the periplasmic space and are extruded via the AcrB/AcrA/TolC complex across the outer membrane and into the extracellular space. Library targeted residues are highlighted by blue spheres for reference and the red dot indicates the region where many of the enriched variants clustered. On the right is a blow up of the loop-helix motif abutting the central funnel where enriched mutations in isobutanol were identified (red and teal spheres), presumably affecting solute transport from the periplasmic space. Mutants targeting the T60 position (teal spheres) was also enriched in the presence of erythromycin. FIG. 23B depicts confirmation of N70D and D73L mutations for tolerance to isobutanol. The N70D mutation in particular appears to improve the final OD to a significant degree. Reconstructed strains were measured for final OD in capped 1.5 mL eppendorf tubes following 48 hours incubation. Error bars are derived from N=3 trials and p-values derived from a one-tailed T-test. FIG. 23C depicts improved growth of the AcrB T60N mutant was observed in inhibitory concentrations of erythromycin (200 µg/mL) and isobutanol (1.2%) in shaking 96 well plate, indicating that this mutation may enhance the efflux activity of this pump towards many compounds. For these experiments CREATE cassette designs were individually synthesized, cloned and sequence verified before recombineering into *E. coli* MG1655 to reconstruct the mutations and the genomic modifications were sequence verified by colony PCR to confirm the genotype-phenotype association.

Figure 24A:
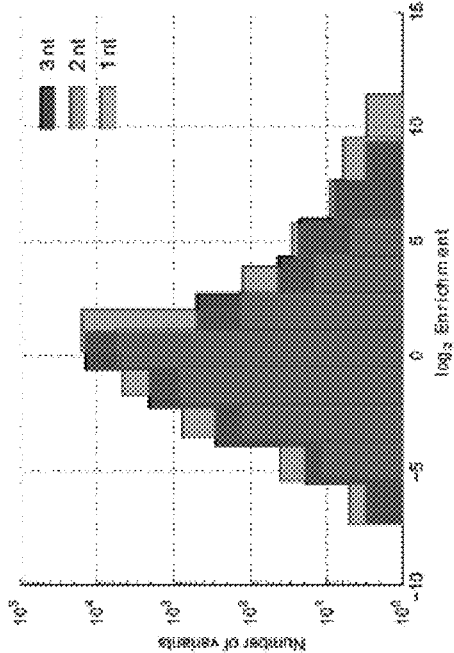
FIGS. 24A-24D depict an example mutant variant assessment analysis.
Figure 24B:
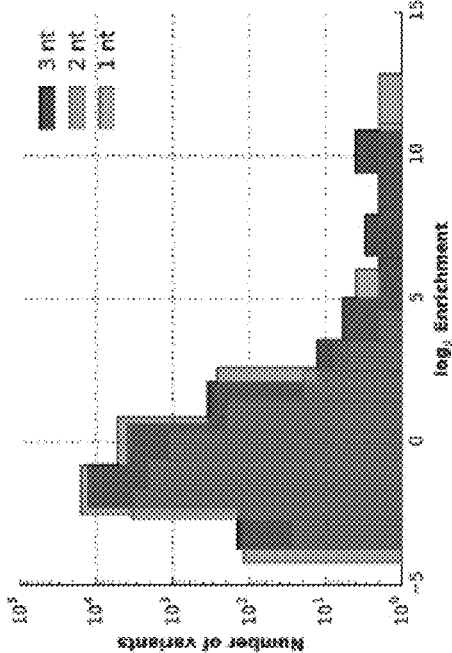
Figure 24C:
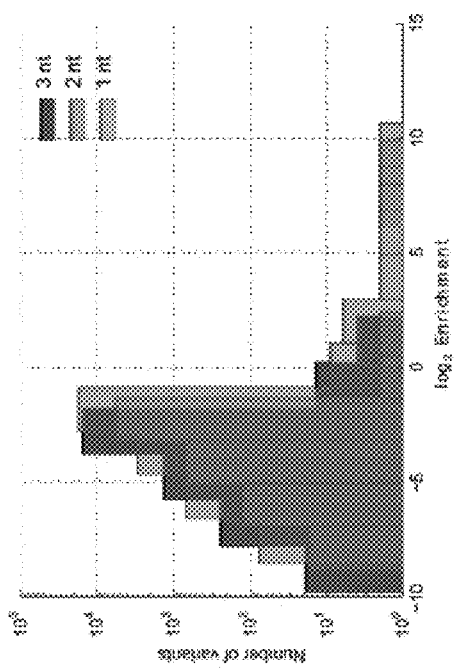
Figure 24D:
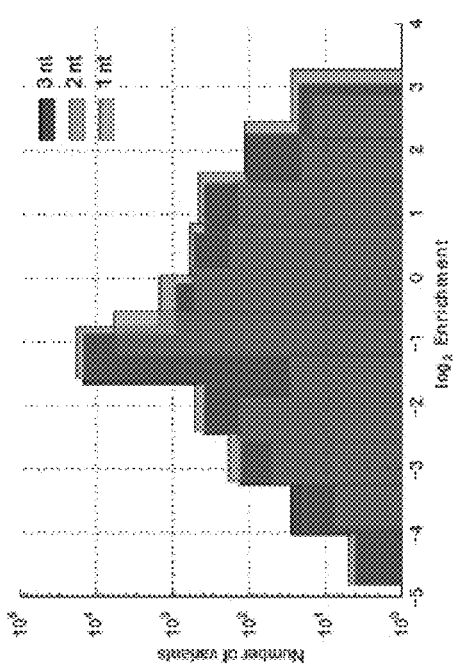

Example 24—Benefits of Rational Mutagenesis for Sampling Novel Adaptive Genotypes FIGS. 24A-24D depict the number of variants detected in CREATE experiments involving 500 µg/mL rifampicin (FIG. 24A), 500 µg/mL erythromycin (FIG. 24B), 10 g/L acetate (FIG. 24C), and 2 g/L furfural (FIG. 24D). While naturally evolving systems or error-prone PCR are highly biased towards sampling single nucleotide polymorphisms (e.g. 1 nt mutations, red) these histograms illustrate the potential advantages for rational design approaches that can identify rare or inaccessible mutations (2 and 3 nt, green and blue respectively). For example, the highest fitness solutions appear to be biased toward these rare mutations in rifampicin, erythromycin and furfural selections to varying degrees. These results indicate that procedures such as CREATE should allow more rapid and thorough analysis of fitness improving mutations, in much the same way that computational approaches are being used to improve directed evolution for protein engineering.

Example 25—Reconstruction of Mutations Identified by Erythromycin Selection

Figure 25:
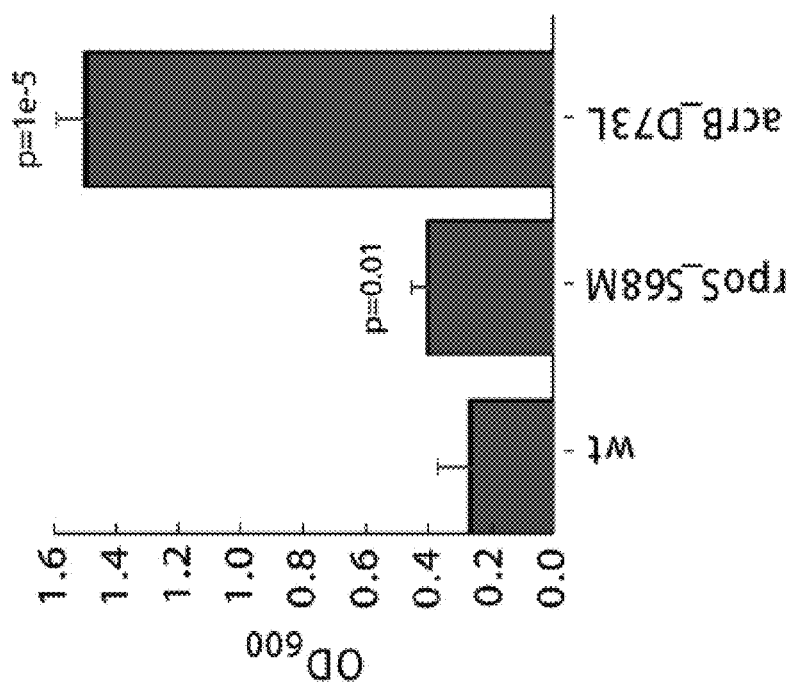
FIG. 25 depicts an example of reconstruction of mutations identified by erythromycin selection.

FIG. 25 depicts reconstructed strains grown in 0.5 mL in capped 1.5 mL eppendorf tubes following 48 hours incubation in the presence of 200 µg/mL erythromycin and final OD measurements assessed. Error bars are derived from N=3 trials. A one tailed T-test was performed on each set of measurements to determine p-values indicated for significance of growth benefit.

Example 26—Validation of Crp S28P Mutation for Furfural or Thermal Tolerance

Figure 26A:
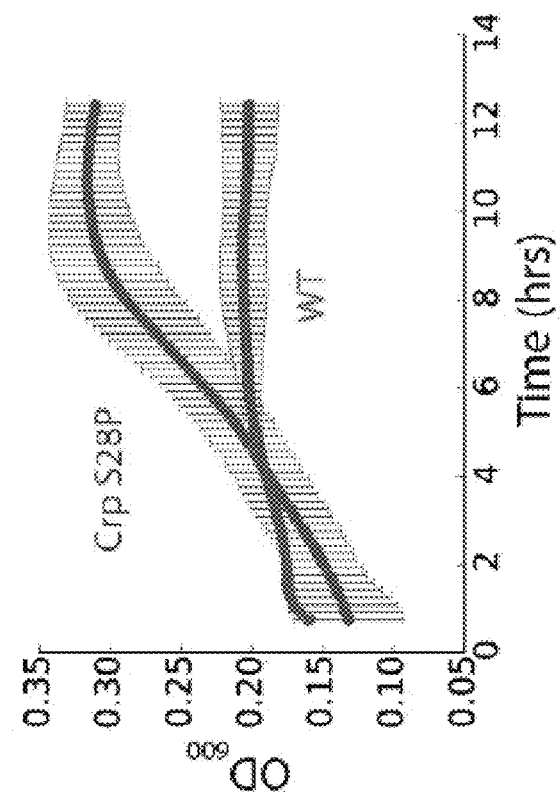
FIGS. 26A-26B depict an example of validation of Crp S28P mutation for furfural or thermal tolerance.
Figure 26B:
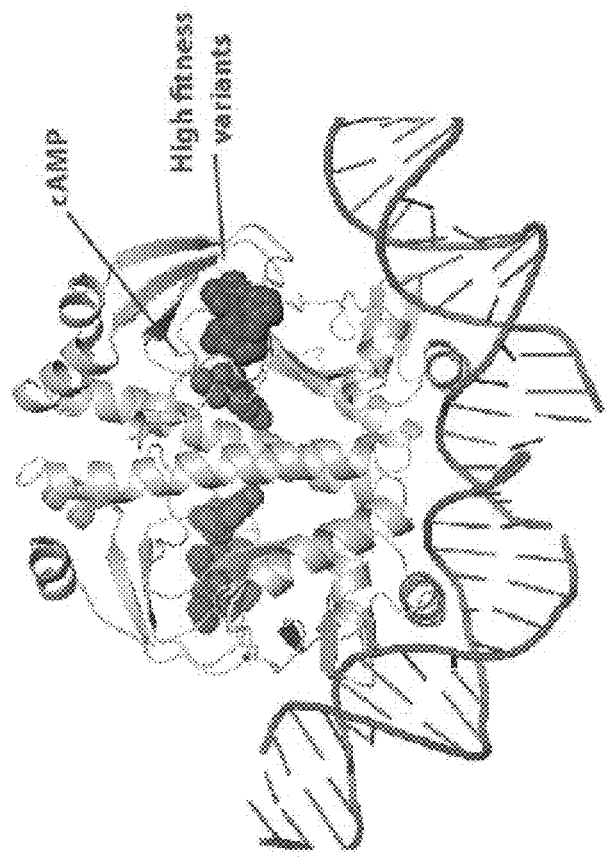

FIG. 26A depicts a crystal structure of the Crp regulatory protein with variants identified by furfural selection highlighted in red (PDB ID 3N4M). A number of the CREATE designs targeting residues near the cyclic-AMP binding site (aa. 28-30, 65) of this regulator were highly enriched in minimal media selections for furfural or thermal tolerance suggesting that these mutations may enhance *E. coli* growth in minimal media under a variety of stress conditions. FIG. 26B depicts validation the Crp S28P mutant identified in 2 g/L furfural selections in M9 media. This mutant was reconstructed as described for AcrB T60S in Example 23.

Example 27—Genome-Scale Sequence to Activity Relationship Mapping at Single Nucleotide Resolution Advances in DNA synthesis and sequencing have motivated increasingly complex efforts to rationally program genomic modifications on laboratory timescales. Realization of such efforts requires strategies that span the design-build-test forward-engineering cycle by not only precisely and efficiently generating large numbers of mutant designs but also by mapping the effects of these mutations at similar throughputs. CRISPR EnAbled Trackable genome Engineering (CREATE) couples highly efficient CRISPR editing with massively parallel oligomer synthesis to enable trackable precision editing on a genome wide scale. This can be accomplished using synthetic cassettes that link a targeting guide RNA with rationally programmable homologous repair cassettes that can be systematically designed to edit loci across a genome and track their phenotypic effects. We demonstrated the flexibility and ease of use of CREATE for genome engineering by parallel mapping of sequence-activity relationships for applications ranging from site saturation mutagenesis, rational protein engineering, complete residue substitution libraries and reconstruction of prior adaptive laboratory evolution experiments.

Additional methods are described in Garst A D, et al.; Nature Biotechnol. 2017 January; 35(1)L48-55, which is incorporated herein by reference in its entirety. Additional methods are described in Garst, A, et al.; Microb Cell Fact. 2013 Oct. 30; 12:99, which is incorporated herein by reference in its entirety.

Validation of CREATE Cassette Design

In order to realize our engineering objectives we took into account a number of key design considerations to both maximize the editing efficiency as well as distill a complex design process into an easily executable workflow. For example, each CREATE cassette is designed to include both a targeting guide RNA (gRNA) and a homology arm (HA) that introduces rational mutations at the chromosomal cleavage site (e.g. FIG. 8A). The HA encodes both the genomic edit of interest coupled to a synonymous PAM mutation that is designed to abrogate Cas9 cleavage after repair (e.g. FIG. 8B). This arrangement not only ensures that the desired edit can be selectively enriched to high levels by Cas9 but also that the sequences required to guide cleavage and HR are covalently coupled during synthesis and thus delivered simultaneously to the same cell during transformation. The high efficiency editing of CRISPR based selection in *E. coli* should also ensure a strong correlation between the CREATE plasmid and genomic sequences and allow the plasmid sequence to serve as a trans-acting barcode or proxy for the genomic edit (e.g. FIG. 8C). Assuming that changes in the plasmid frequency under different selective pressures are correlated to their associated genomic edit thereby allows the impact of precise genomic modifications at many loci to be monitored in parallel using a simple downstream sequencing approach to map enriched genotypes on a population scale, analogous to previous genomic tracking methodologies.

To test this concept we first performed control experiments using a CREATE cassette designed to inactivate the galK gene by introducing a single point mutation to convert codon 145 from TAT to a TAA stop codon (e.g. FIG. 8B) using a 120 bp HA. The editing efficiency of this cassette using Cas9 and the nuclease deficient dCas9 control was evaluated using a red/white colony screening assay (e.g. FIG. 8A-B, FIG. 15A-15C). These experiments also indicated that HR between a circular double stranded plasmid and the chromosome is strongly dependent on the Cas9 cleavage as recombination is not observed in the absence of the active enzyme (e.g. FIG. 15A-15D). This is in contrast to single stranded recombineering approaches in which oligonucleotides anneal with high efficiency at the lagging strand of the replication fork. Cas9 also adversely impacts the overall transformation efficiency due to toxicity of dsDNA cleavage in E. coli (e.g. FIG. 9A-9D). This toxicity is further exacerbated when performing CREATE at two sites simultaneously in the same cell (e.g. FIG. 16A-16E); which when combined with the absence of an effective non-homologous end joining pathway strongly supports the fact that off target editing events should be rare within a recombineered library. Additionally, toxicity limits the size of library construction and coverage, however we note that the observed $10^4$-$10^5$ variants/μg DNA (e.g. FIG. 9A) is on a scale compatible with current oligo synthesis capabilities ($10^{4-5}$ oligos per order). Thus, we anticipated that using the CREATE synthetic oligo design, we would be able to simultaneously generate ~$10^5$ or more designer mutations at any location in the genome and precisely map such mutations onto a targeted phenotype.

To further characterize how changes in the CREATE cassette design influence the editing efficiency we varied the HA length (80-120 bp) and the distance between the PAM-codon/TS (17-59 bp) (e.g. FIG. 9B). Induction of Cas9 revealed that all of these cassette variants can support high efficiency HR. High efficiency conversion is also observed in the absence of Cas9 induction indicating that low level expression of Cas9, due to a leaky inducible promoter, is sufficient to drive cleavage and HR (e.g. FIG. 9B). To verify that the edits matched our intended design we sequenced the chromosome of randomly chosen clones and found that 71% (27/38) contained a perfect match to the CREATE design, while 26% (10/38) contained only the PAM edit and the remaining 3% (1/38) appeared to be wt escapers. As an additional test of design flexibility performed similar experiments using deletion cassettes that that introduce different sized deletions (e.g. FIG. 17A-17D) and observed similar efficiencies (>70%) indicating that the same design automation and tracking capabilities should readily extend to a variety of design objectives (e.g. FIG. 13A-13D).

High-Throughput Design and Multiplexed Library Construction

To scale the CREATE process for genome-wide applications we developed a custom software to automate cassette design that takes into account the above mentioned criteria to systematically identify a PAM sequence nearest to a target site (TS) of interest and modify it to create a synonymous PAM mutation. This design software is part of a suite of web-based design tools that can be implemented for E. coli and is under further development for other organisms as well as an expanded set of CRISPR-Cas systems. This software platform enables high-throughput rational design of genomic libraries in a format that is compatible with parallelized array based oligo synthesis and simple homology based cloning methods that can be performed in batch for library construction (e.g. FIG. 8B).

Using this design software we generated a total of 52,356 CREATE cassettes for a range of applications where sequence to activity mapping by traditional methods would be time-consuming and prohibitively expensive. Briefly, the library designs included: 1) a complete saturation of the folA gene to map the entire mutational landscape of an essential gene in its chromosomal context 2) saturation mutagenesis of functional residues in 35 global regulators, efflux pumps and metabolic enzymes implicated in a wide range of tolerance and production phenotypes in E. coli 3) a reconstruction of the complete set of nonsynonymous mutations identified by a recent adaptive laboratory evolution (ALE) study of thermotolerance, and 4) promoter engineering libraries designed to incorporate UP elements or CAP binding elements at transcription start sites annotated in RegulonDB (e.g. FIG. 13A-13D).

The pooled oligo libraries were amplified and cloned in parallel and a subset of single variants were isolated to further characterize editing efficiency at different loci (e.g. FIG. 9C). Amplification and sequencing of the genomic loci after transformation with the CREATE plasmids revealed editing efficiencies of 70% on average (106 of 144 clones sampled at seven different loci), with a range of 30% for the metA_V20L cassette to 100% for the rpoH_V179H cassette. Interestingly, the differences in editing efficiency for each cassette were highly correlated with the distance between the PAM and target codon (e.g. FIG. 9D), a feature that also appears to affect the ability of linear DNA templates to effectively introduce targeted mutations (e.g. FIG. 18A-18B). This relationship suggests that subsequent CREATE designs should readily increase editing efficiency by optimizing PAM selection criteria. We also note that differences in editing efficiency may reflect detrimental effects of some mutations on organismal fitness (metA is considered an essential gene in most media conditions), and that there may be an upper bound on the number of mutations that can be observed for a particular protein. Finally, these data were obtained outside of any specific selective or screening steps that enrich for chromosomal mutants of interest, and as such demonstrate the ability of this approach to construct mutational libraries.

To further characterize the fidelity of the multiplexed synthesis and cloning procedures we performed deep sequencing on the pooled libraries (e.g. FIG. 19A-D). From 594,998 total reads of the cloned CREATE cassette libraries, 550,152 (92%) passed quality filtering and produced hits against the design database. Of these we observed a perfect match for 34,291 (65%) of the possible unique variants and note that many cassettes that were missing in this initial pool were observed in later selections, suggesting that at the cloning stage we can readily cover the majority of the intended design space. In depth analysis of these reads revealed that 46% of the reads passing quality filter were exact matches to their intended design, with the remainder containing 1-4 bp indels or mismatches, primarily in the HA region near the designed mutation site (e.g. FIG. 19A). The mutational bias in this region suggests that the repetitive spacer elements in the HA and gRNA portions of the cassette may form secondary structures that adversely affect sequencing or synthesis (e.g. FIG. 19B). We note that these variant designs are easily identified via the CREATE plasmid-barcoding strategy, and that in some cases it may be desired to have this added diversity in the generated library. We also observed significant ($p<0.05$) correlation between variant frequencies from the cloned pools and after overnight recovery following recombineering, as well as between replicate recombineering experiments (e.g. FIG. 20A-20B). These results suggest that well represented variants should be readily tracked by our methodology with a precision similar to previous CRISPR based saturation mutagenesis procedures performed at a single loci.

CREATE Based Protein Engineering

To test the robustness of the CREATE methodology for protein engineering at a single gene level we performed deep-scanning mutagenesis of the essential folA gene. This gene encodes the dihydrofolate reductase (DHFR) enzyme responsible for the production of tetrahydrofolate and the biosynthesis of pyrimidines, purines and nucleic acids. DHFR is also the primary target of the antibiotic trimethoprim (TMP) and other antifolates that are used as antibiotics or chemotherapeutics. The wealth of structural and biochemical data DHFR function and antibiotic resistance make it an ideal model for validation of the approach.

A CREATE library designed to saturate every codon from 2-158 of the DHFR enzyme was recombineered into E. coli MG1655 and allowed to recover overnight. Following recovery ~$10^9$ cells (1 mL saturated culture) was transferred into media containing inhibitory TMP concentrations and allowed to grow for 48 hours. The resulting plasmid populations were then sequenced to assess our ability to capture information at the level of single amino acid substitutions that can confer TMP resistance (e.g. FIG. 10A-10B). Bootstrapped confidence intervals for mutational effect were derived using the enrichment data of the 158 synonymous mutations included in this experiment (e.g. FIG. 10A-10B). Using this criteria, we observed significant ($P<0.05$) levels of enrichment for 74 substitutions (2.3% of the design space) covering 49 aa positions in the protein. Although this degree of mutational flexibility of an essential enzyme may seem counterintuitive, it supports previous conclusions that this enzyme has not reached its evolutionary optimum and that many mutations that can improve TMP tolerance through enhancement of the endogenous enzymatic activity or alteration of the dynamic folding landscape of this enzyme.

These results also support the fact that we probe more deeply into the mutation space of improved fitness variants using rational mutagenesis strategies. For example, we observed 7 significantly enriched substitutions at position F153 (e.g. FIG. 10A-10B), none of which have been previously identified by error-prone PCR and adaptive laboratory evolution (ALE). To validate these specific mutations, we reconstructed F153R and F153W variants, which had not been previously reported in the literature and spanned a large range of the measured enrichment scale at this position (e.g. FIG. 10D-10F). We confirmed that the highly enriched F153R mutant grows rapidly under a large range of TMP concentrations while the F153W mutant demonstrates growth only at the moderate TMP concentration used in the selection, consistent with their respective enrichment scores (e.g. FIG. 10A-10F). Moreover, 6 of the 7 mutations we identified using CREATE require two nucleotide changes to convert the wt TTT codon to one of the observed amino acids (I: 1 nt, W: 2 nt, D: 2 nt, R: 2 nt, P: 2 nt, M: 2 nt, H: 2 nt). The F153R and F153W mutations also appear to impact the native enzyme activity in distinct ways (e.g. FIG. 21), implying that these substitutions may confer tolerance by altering the enzymatic cycle of this enzyme in distinct manners.

In addition to mapping substitutions that confer TMP resistance, we also attempted to identify substitutions that affect the native activity of DHFR. To do so, we compared the frequencies of each plasmid variant after overnight growth in M9 (e.g. FIG. 22A-22C). In this case, we observed similar overall enrichment profiles for both synonymous and nonsynonymous mutation sets, with very few mutations observed to have significant impact on growth. This unexpected result suggests a need for greater sequencing depth and/or alternate selection strategies to assign high confidence to low fitness variants.

As a separate validation of protein engineering applications, we generated a 4,240 variant library targeting the AcrB multidrug efflux pump in E. coli (e.g. FIG. 23A-23F). This protein acts as a proton exchange pump that exports a wide variety of chemicals including antibiotics, chemical mutagens, and short chain alcohols that are being pursued as next generation biofuels and motivating numerous engineering efforts. The library was designed to target the interior chamber, the exit funnel that channels substrates towards the outer-membrane component of the AcrB/AcrA/TolC complex, and key regions of the transmembrane domain where mutations conferring tolerance to isobutanol and longer chain alcohols have been identified (e.g. FIG. 23A-23C). We then constructed the AcrB CREATE library identically as for the FolA library and grew the library in the presence of 1.2% isobutanol. Sequencing identified multiple mutations to the loop-helix motif adjacent to the central efflux funnel that were significantly enriched, suggesting this substructure may provide a novel target for engineering enhanced efflux activity. Reconstruction of the AcrB N70D and D73L mutations also confirmed the ability of these mutations to enhance overall growth in the presence of this solvent stress (e.g. FIG. 23D).

Parallel Evaluation of Genotype Fitness from Large Scale Adaptation Studies

We next sought to expand our efforts from the single protein scale and validate the use of CREATE at the genome-scale. To do so we chose to reconstruct and map mutations resulting from a prior adaptive laboratory evolution study of E. coli thermal tolerance. ALE has been used extensively as a tool to study the bacterial adaptation in response to a broad range of environmental stressors. However, in the majority of cases the genome undergoes multiple mutations making it difficult to assess the contribution of each mutation to the phenotype in question. Here, we designed and constructed a CREATE library to include all 645 nonsynonymous mutants from the Tenaillon et al ALE experiment and then subjected this library to growth selection in minimal media at 42.2° C. To assess any possible effects that could arise from the synonymous PAM mutation we included redundancy in the design of this library such that each target codon was coupled to two different PAM mutations to provide a 4 fold design redundancy for each nonsynonymous mutation. For calibration purposes the ALE library was pooled with the protein targeting libraries to allow for relative enrichment comparisons from the non-ALE derived libraries as a benchmark (e.g. FIG. 11A-11C). Of the more than 50,000 cassettes in this experiment we observed 405 cassettes from the ALE derived library above the minimal counting threshold, pertaining to 252 unique variants (e.g. FIG. 11B). Of these 346 cassettes (encoding 231 nonsynonymous changes) were significantly enriched compared with the synonymous controls (e.g. FIG. 11B), suggesting that 92% (231/252) of the mutations sampled confer significant selective growth advantages as individual chromosomal mutations, consistent with their fixation during adaptive growth. Additionally we found that 141 mutations from the additional CREATE libraries were also significantly enriched, with 86 of these targeting residues in or around the cAMP binding site of Crp, a central regulator of carbon metabolism. The identification of such a large number of Crp mutants is highly suggestive of a role for Crp in thermal-tolerance in agreement with previous findings.

For each mutant we also calculated the number of mutations required to convert the wt codon to each of the other 19 amino acids (e.g. FIG. 11C). As with folA, we found that highly impactful mutations, such as the crp S28P and L30Y mutations, require more than a single nucleotide substitution and would therefore be inaccessible or exceedingly rare in naturally evolving systems under laboratory timescales. In fact, this seemed to be a recurrent theme across many of the selections we performed (e.g. FIG. 24A-24D) highlighting again the value of synthetic DNA driven search strategies for genomic engineering applications.

High-Throughput Mapping of Selectable Precision Edits on a Genome Wide Scale

To further validate the method for genome-scale mapping and exploration we challenged genome wide targeting libraries with antibiotics or solvents relevant to bioproduction (e.g. FIG. 12A-12F). In the case of selections performed with rifampicin, an antibiotic that inhibits transcription by the RNA polymerase (e.g. FIG. 12A, inner circle) we observed a number of enriched variants that highlighted the robustness of the CREATE approach for atomic resolution mapping. For example, 10 of the top 50 hits identified mutations to residues I572, L533 and S531 of the RNA polymerase 3 subunit (encoded by rpoB) including variants that form part of the rifampicin binding site (e.g. FIG. 12B). In 6 of the 7 enriched variants the data suggest that a bulky substitution is necessary to sterically hinder 7 rifampicin binding. In addition to the β-subunit mutations the rifampicin selections enriched a number mutations to the MarA transcriptional activator, whose over-expression due to marR knockout is a well studied aspect of multiple antibiotic resistance (MAR) phenotypes in $E.$ $coli$. In the DNA bound crystal structure of MarA, Q89 is positioned near the DNA backbone but pointed into solution due to a steric clash between other possible rotamers and nearest phosphate group on the DNA backbone (e.g. FIG. 12C). Modeling of the MarA Q89N and Q89D mutations identified by this selection suggests that shortening the side chain by a single carbon unit may enable new protein-DNA H-bonding interactions and thereby improve the overall MAR induction response.

To compare these results to an antibiotic that interferes with translation we performed another round of selections in the presence of erythromycin (e.g. outer circle FIG. 12A). The enrichment profiles from this selection again highlighted loci previously implicated in resistance to this antibiotic. For example, we observed strong enrichment of 4 different mutations to the AcrB efflux pump which acts as the primary exporter of this drug from the periplasmic space (e.g. FIG. 12A). Interestingly, one of the variants (AcrB T60N) appears at the same residue identified from isobutanol selections (e.g. FIG. 23A-23F). As with the other mutations, reconstruction validated that at least two of these mutations (e.g. T60N in FIGS. 23E-23F and D73L in FIG. 25) can significantly improve tolerance to both erythromycin as well as isobutanol isobutanol, further supporting the idea that this motif may provide a useful engineering target for broad range of tolerance phenotypes. In addition to AcrB we also observed enrichment of multiple soxR and rpoS mutants, both of which have been previously implicated in stress tolerance and general antibiotic resistance phenotypes. In total, we observed 136 of the 341 significantly enriched mutations (40%) were identified within the RpoB, MarA, MarR, SoxR, AcrB, or dxs proteins, each of which has extensive prior validation as antibiotic resistance genes.

Finally, we performed selections using furfural or acetate, common components of cellulosic hydrolysate that inhibit bacterial growth under industrial fermentation conditions and are thus the target of many strain engineering efforts (e.g. FIG. 12D-12F). In the presence of high acetate concentrations (10 g/L, e.g. inner plot FIG. 12D) the top 100 ranking mutations were predominated by cassettes targeting the fis, fadR, rho and fnr genes respectively (e.g. FIG. 12E). The Fis, Fnr and FadR regulators are all involved transcriptional regulation of the primary acetate utilization gene acs, and implicated in the so-called "acetate-switch" which allows the cell to effectively scavenge acetate. Knockout of these regulators leads to constitutive expression of the acetate utilization pathways and improved acetate growth phenotypes suggesting that the mutations identified in this study (e.g. FIG. 12E-12F) likely inhibit these regulatory functions by destabilizing their respective protein targets.

In contrast to the weak acid tolerance of acetate, the enrichment profiles obtained the presence of growth inhibiting concentrations of furfural (2 g/L) were significantly different with the most frequently observed mutations targeting the oxidative stress response regulator rpoS (e.g. FIG. 12F). Furfural growth inhibition is thought to occur through depletion of cellular NADPH pools, an important cofactor in the prevention of oxidative stress and anabolic pathways for cell growth. In line with our findings, previous studies of RpoS have demonstrated that inactive alleles are favored in such nutrient depleted scenarios. Interestingly, we also observed some of the same mutations in crp that were observed in the 42.2° C. selections (e.g. FIGS. 11A and 11C) and upon reconstruction confirmed that the Crp S28P mutant can substantially improve growth in the presence of furfural (e.g. FIG. 26A-26B). We also found that this selection uniquely enriched for variants of the PntA transhydrogenase, a membrane bound transhydrogenase that transfers hydride ions from NADH to NADP+ to maintain sufficient pools for anabolism. A mutation to I258A in close proximity to the substrate binding cleft may therefore impart enhanced NADPH production.

Collectively, these selections validate the CREATE strategy by demonstrating the ability to map known associations as well as highlight power of this method for rapid mapping of novel mutations to traits of interest. It is also important to note that in contrast to the most other functional genomics technologies that mainly identify loss of function mutations, the ability to perform such broad scale scanning mutagenesis opens the door for more general genomic searches that can also identify novel gain of function mutations.

In this work we have demonstrated that CREATE allows parallel mapping of tens of thousands of amino acid and promoter mutations in a single experiment. The construction, selection, and mapping of >50,000 genome-wide mutations (e.g. FIGS. 11A-11C and 12A-12F) can in some examples be accomplished in 1-2 weeks by a single researcher, offering orders of magnitude improvement in economics, throughput, and target scale over the current state of the art methods in synthetic biology. Importantly, the ability to track the enrichment of library variants allows multiplex sequence to activity mapping by a simple PCR based workflow using just a single set of primers as opposed to more complicated downstream sequencing approaches that are limited to a few dozen loci. In addition, the ability to map the effects of single nucleotide or amino acid level variation in coding regions or promoters allows CREATE to address a considerably more diverse set of design objectives than previous high-throughput genomic technologies such as trackable multiplexed recombineering (TRMR) or Tn-seq approaches that are limited to gene resolution analysis. Such capabilities enable new paradigms for deciphering gene function and engineering cellular traits including workflows in which iterative rounds of CREATE could be implemented to perform design-driven genome engineering and address a broad range of ambitions.

Notably, as a further distinction from prior approaches, the high efficiency mutagenesis (e.g. FIG. 9A-9D) reported in this work was not only an order of magnitude improved but was also achieved in a wild type MG1655 strain in which all of the native DNA repair pathways are intact. The majority of previously reported recombineering efforts in *E. coli* have used single-stranded oligo engineering which requires deletion of the mismatch repair genes or chemically modified oligonucleotides to achieve mutagenesis at 1-30% efficiency. The combination of plasmid based homologous recombination substrates and Cas9 dsDNA cleavage appears to circumvent these requirements (e.g. FIG. 13A-13D and FIG. 9A-9D), eliminating the need for specialized genetic modifications outside of the Cas9 and X-RED genes to perform efficient editing and tracking on a population scale (e.g. FIG. 9A-9D). This fact alongside the broad utility of CRISPR editing suggests that the CREATE approach will readily port to a wide range of microorganisms such as *Saccharomyces cerevisiae* and other recombinogenic bacteria for which high-efficiency transformation protocols are available. The CREATE strategy should also be compatible with a wide range of CRISPR/Cas systems using similar automation approaches to design and tracking. Extension of this methodology to higher eukaryotes however will require the development of strategies to overcome non-homologous end-joining as well as alternative tracking systems that can stably replicate.

The CREATE strategy provides a streamlined approach for sequence to activity mapping and directed evolution by integrating multiplexed oligo synthesis, CRISPR-CAS editing, and high-throughput sequencing.

Example 28—Genome-Scale Sequence to Activity Relationship Mapping at Single Nucleotide Resolution, Additional Examples Possible Effects of Inconsistent Mapping of Plasmid Barcode to Genomic Edit We note that the initial CREATE library included designs that we would expect to have low confidence mapping between the plasmid barcode and the genomic edit (as explained primarily by distance between the PAM and target mutation in the CREATE cassette, see FIG. 2*d*). We describe below the various scenarios that may arise in the fraction of cases where the plasmid tracking may lead to erroneous conclusions regarding a genomic variant. A few things to note in evaluating these scenarios include i) the plasmid cassette should have minimal or no functional influence relative to the genomic edit, ii) the genomic loci will only be either the WT sequence or the sequence from the editing cassette that we obtain via sequencing, and iii) offsite editing is highly unlikely given the toxicity of CRISPR-Cas editing of multiple sites (e.g. FIG. 16A-16E) or when performed in the absence of an added editing-repair template. Finally, we note that the use of replicate experiments and deeper sequencing can also address these issues.

Tracking of High Fitness Variants (Positive Enrichment Tracking)

In cases where there is a strong selective advantage for the genomic modification (and thus the associated plasmid) we will only observe cells with the edit in the chromosome post selection. Thus, this is almost always a true positive particularly when selection times are short, thus limiting the possibility of random mutations due to replication error sweeping the population. While this phenomenon may lead to a quantitative underestimation of the true fitness of a mutation due to an enrichment profile that represents the convolution of modified and wt fitness, it will not produce false positives. Moreover, the use of replicated experiments and/or longer selections can also address this potential issue and eliminate erroneous conclusions regarding a mutations impact on fitness.

Tracking of Low Fitness Variants (Negative Enrichment Tracking)

In cases where the encoded mutation has a negative fitness contribution but is linked to a PAM only or unmodified chromosome we would incorrectly overestimate the fitness of the mutant and assume that it is closer to wt, especially for longer selection times (e.g. see FIG. 22A-22C). However, any deep sequencing approach must deal with similar limitations due to the lack of information regarding such mutations following selection and the problems associated with counting statistics in these scenarios. Moreover, we would note that this scenario is only relevant to the subset of truly negative fitness mutants (which should be 10-20% based on historic directed evolution and ALE data) within the unedited fraction (~30%) and that remain in the unedited fraction in multiple replicate transformations. In other words, it is a small percentage (4-5%) scenario that can be detected and/or addressed through replicate transformations where one would observe inconsistencies in the particular mutant showing up occasionally with WT fitness.

Incomplete Coverage

In cases where a variant is not present in the initial population (due to both low transformation efficiency and low editing efficiency) a couple of scenarios could arise. As implied by the points above, if the mutation is beneficial one could falsely conclude that it does not confer a fitness advantage, and if it is truly deleterious it also could be incorrectly assigned a neutral fitness score. This appears to be encountered sometimes in this work and impacts both the error associated with replicate measurements and our ability to distinguish low fitness variants from a synonymous control. However, our ability to identify beneficial mutants is robust despite these issues as evidenced by our ability to readily identify novel and previously validated mutations. Strategies to address this by overcoming Cas9 toxicity and improving recombineering efficiencies hold promise to largely eliminate such problems. Furthermore, increasing the number of replicates, increasing sequencing depth, and/or improving the library coverage by performing larger scale transformation also can help to address these issues.

Off Target gRNA Cleavage

Off target gRNA cleavage should be rare in *E. coli* due to the relatively small size of its genome (4 Mb), and thus lack of (non-targeted) regions of homology to the CREATE cassette. Moreover, the toxicity of gRNAs in the presence of Cas9 (e.g. FIG. 9A) ensures that cells survival is compromised in *E. coli* due to dsDNA breaks. Each additional cut introduced into *E. coli* appears to incur multiplicative toxicity effects, even when homologous repair templates are provided for each cut site (e.g. FIG. 16A-16E). This toxicity effect would be further exacerbated by the absence of a repair template to guide HR (e.g. FIG. 16A-16E), as would be the case for an off-target cleavage event from a single gRNA targeting two sites but containing only a single HA.

Random Off Target Mutagenesis (Evolution)

The probability that a CREATE variant is strongly enriched due to an off target mutation even is highly improbable due to 2 factors: 1) the toxicity effect for the reasons stated above and 2) the low mutation rates of MG1655 or other mutation repair proficient strains compared with the mutagenesis rates of CREATE, particularly in multiple replicates of selection. We also have validated that we can transfer the plasmid pool back into a naive parental background and rapidly verify the enrichment of fitness improving CREATE plasmids from the initial population. Like replicate data, this allows us to decouple each CREATE plasmid from the potential of background mutations that would interfere with our analysis. These factors simplify the assumptions made during our analysis, the validity of which is supported both by externally and internally validated genotypes that were identified during this work.

Possible Effects of Synonymous Mutations

Synonymous mutations (e.g. in the PAM region) can confer unexpected effects on phenotype. We have controlled for this in a number of manners. In every experiment we included an internal control that consists of a library of synonymous mutations (1/20 at each codon or 5% of total input), each of which samples different PAM and codon combinations and thus give us an idea of the range of possible effects we may have on a gene by measuring the enrichment profile of many synonymous changes. Using this population as a control we can accurately identify significant fitness changes at the resolution of single amino acids as the work suggests. We can also control for this effect by utilizing redundant sampling approaches where a site is coupled to multiple PAM mutations similar to what was done for the ALE study described herein.

CREATE Library Design Considerations

A variety of design principles were implemented in the gene targeting libraries described in some work disclosed herein. For example, the folA library (3140 cassettes) was designed to be an unbiased, exploratory library for full single site saturation mutagenesis and sequence activity. However, for the majority of the genes we sought to maximize the probability of interesting genotypes by choosing to focus the diversity of sites most likely to have a functional impact on the targeted protein (e.g. DNA binding sites, active sites, regions identified as mutational hotspots by previous selections). The sites that were included in these library designs were selected based on information deposited in databases including Ecocyc (biocyc.org/), Uniprot (uniprot.org/), and the PDB (rcsb.org/pdb) as well as relevant literature citations that identified residues or regions of interest using directed evolution approaches. The Uniprot and Ecocyc databases provide manually curated sequence features that indicate mutational effects and important domains of each protein. In cases where there was enough structural information to model ligand or DNA binding sites the relevant crystal structures were loaded into Pymol and manual residue selections were made and exported as numerical lists. For promoter libraries we took into account the spacing of these sites relative to the transcription start site and the canonical recognition sequence of either the CRP binding site (AAATGTGAtctagaTCACATTT (SEQ ID NO: 184) located between −72 and −40 relative to the transcription start site) or the UP element (AAAATTTTTTTTCAAAAGTA (SEQ ID NO: 185) −60 from the transcription start site) that directly recruit the alpha subunit of the RNA polymerase. These sequences were designed to integrate at these positions relative to the publicly available transcriptional start site annotations in RegulonDB using a variation of the automated CREATE design software designed for protein targeting (e.g. FIG. 13A-13D). These cassettes were made with the intent of assessing the effects of gene dosage and regulation on fitness. Finally, we designed a library to reconstruct all of the 645 non-synonymous mutations targeting 197 genes that were identified by a comprehensive ALE experiment in which the complete genomes of 115 isolates were sequenced after a year of adaptation to growth at elevated temperature (e.g. 42.2° C.). In all, we designed 52,356 oligomers, with 48,080 intended to saturate 2404 codon positions across 35 genes, 2,550 oligos were made for regenerating the ALE mutations, 379 UP promoter mutants and 772 CAP promoter mutations in a manner that would allow simultaneous sequence to activity relationship mapping.

Cassette Design and Automation Principles

Based on the control experiments with galK (e.g. FIG. 9A-9D) and current maximal commercial synthesis length constraints (200 bp from Agilent) we developed a general design for each CREATE cassette (e.g. FIG. 8A-8B).

Design of the CREATE cassettes was automated using custom Python scripts. The basic algorithm takes a gene sequence, a list of target residues, and a list of codons as inputs. The gene sequence is searched for all available PAM sites with the corresponding spacer sequence. This list is then sorted according to relative proximity to the targeted codon position. For each PAM site in the initial list the algorithm checks for synonymous mutations that can be made in-frame that also directly disrupt the PAM site, in the event that this condition is met the algorithm proceeds to making the prescribed codon change and designing the full CREATE cassette with the accompanying spacer and iterates for each input codon and position respectively. For each PAM mutation, all possible synonymous codon substitutions are checked before proceeding to the next PAM site. For the codon saturation libraries in this study we chose the most frequent codons (genscript.com/cgi-bin/tools/codon-_freq_table) for each designed amino acid substitution according to the E. coli usage statistics. The script can be run rapidly on a laptop computer and was used to generate the full design of these libraries in <10 minutes. The algorithm used in this study was designed to make the most conservative mutations possible by sometimes using only the PAM as the selectable mutation marker.

Plasmids

The X2-cas9 broad host range vector was constructed by amplifying the cas9 gene from genomic S. pyogenes DNA into the pBTBX2 backbone (Lucigen). A vector map and sequence of this vector and the galK_Y145*_120/17 CREATE cassette are provided at the following locations: benchling.com/s/3c941j/edit; benchling.com/s/xRBDw-cMy/edit. The editing experiments performed in some of this work employed the X2-cas9 vector in combination with the pSIM5 vector (redrecombineering.ncifcrf.gov/strains--plasmids.html) to achieve the reported efficiencies.

Recombineering of CREATE Libraries

Genomic libraries were prepared by transforming CREATE plasmid libraries into a wildtype E. coli MG1655 strain carrying the temperature sensitive pSIM5 plasmid (lambda RED) and a broad host range plasmid containing an inducible cas9 gene from cloned from S. pyogenes genomic DNA into the pBTBX-2 backbone (X2cas9, e.g. FIG. 15A-15D). pSIM5 was induced for 15 min at 42° C. followed by chilling on ice for 15 min. The cells were washed 3 times with ⅕ the initial culture volume of ddH2O (e.g. 10 mL washes for 50 mL culture). Following electroporation the cells were recovered in LB+0.4% arabinose to induce Cas9. The cells were recovered 1-2 hrs before spot plating to determine library coverage and transferred to a 10× volume for overnight recovery in LB+0.4% arabinose+50 µg/mL kanamycin+100 µg/mL carbenicillin. Saturated overnight cultures were pelleted and resuspended in 5 mL of LB. 1 mL was used to make glycerol stocks and the other 1 mL washed with the appropriate selection media before proceeding with selection.

For the control experiments with galK we used CREATE cassettes designed to convert Y145 (TAT) into a stop codon (TAA) with a single point mutation at this position and a second point mutation to make a synonymous mutation that abolishes the targeted PAM site (e.g. FIG. 8B and FIG. 13A-13D). Editing efficiencies (e.g. FIG. 13A-13D and FIG. 9A-9B) were estimated using red/white plate based screening on 1% galactose supplemented MacConkey agar as previously described.

Selection Procedures

Following overnight recovery, the cells were harvested by pelleting and resuspension in fresh selection media. All selections were performed in shake flask and inoculated at an initial OD600 of 0.1. Three serial dilutions (48-96 hrs depending on growth rates in the target condition) were carried out for each selection by transferring 1/100th the media volume after the cultures reached stationary phase. The 42° C. selections were performed in M9 media+0.2% glucose to mimic low carbon availability from the initial adaptation. Antibiotic selections were carried out in LB+500 µg/mL rifampicin or erythromycin to ensure stringent selection. The solvent selections were performed in M9+0.4% glucose and either 10 g/L acetate (unbuffered) or 2 g/L furfural. Selections were harvested by pelleting 1 mL of the final culture and the cell pellet was boiled in 100 µL TE buffer to preserve both the plasmid and the genomic DNA for further desired analyses.

Library Preparation and Sequencing

Custom Illumina compatible primers were designed to allow a single amplification step from the CREATE plasmid and assignment of experimental reads using barcodes. The CREATE cassettes were amplified directly from the plasmid sequences of boiled cell lysates using 20 cycles of PCR with the Phusion (NEB) polymerase using 60° C. annealing and 1:30 minute extension times. As in the cloning procedure a minimal number of PCR cycles was maintained to prevent accumulation of mutations and recombined CREATE cassettes that were observed when an excessive number of PCR cycles was implemented (e.g. >25-30). Amplified fragments were verified and quantified by 1% agarose gel electrophoresis and pooled according to the desired read depth for each sample. The pooled library was cleaned using Qiaquick PCR cleanup kit and processed for NGS using standard Illumina preparation kits. The Illumina sequencing and sample preparation were performed with the primers.

Preprocessing of High-Throughput Sequencing and Count Generation

Paired-end Illumina sequencing reads were sorted according to the golay barcode index with allowance of up to 3 mismatches then merged using the usearch-fastq_merge algorithm. Sorted reads were then matched against the database of designed CREATE cassettes using the usearch_global algorithm at an identity threshold of 90% allowing up to 60 possible hits for each read. The resulting hits were further sorted according to percent identity and read assignment was made using the best matching CREATE cassette design at a final cutoff 98% identity to the initial design. It should be noted that this read assignment strategy attempts to identify correlations between the designed genotypes and may therefore miss other important features that arise due to mutations that could occur during the experimental procedure. This approach was taken both to simplify data analysis as well as evaluate the 'forward' design and annotation procedure and it's ability to accurately identify meaningful genetic phenomena.

Data Analysis and Fitness Calculation

Enrichment scores (or absolute fitness scores) were calculated as the log 2 enrichment score using the following equation:

$$W = \log 2\left(\frac{F_{x,f}}{F_{x,i}}\right),$$

where $F_{x,f}$ is the frequency of cassette X at the final time point and $F_{x,i}$ is the initial frequency of cassette X and W is the absolute fitness of each variant. Frequencies were determined by dividing the read counts for each variant by the total experimental counts including those that were lost to filtering. Each selection was performed in duplicate and the count weighted average of the two measurements was used to infer the average fitness score of each mutation as follows:

$$W_{avg} = \frac{\sum_{i=1}^{N} counts_i * W_i}{\sum_{i=1}^{N} counts_i}$$

These scores were used to rank and assess the fitness contributions of each mutation under the various selection pressures investigated. For all selections we took average absolute fitness scores for all of the synonymous mutants as a composite measure of the average growth rate. Absolute enrichment scores were considered significant if the mutant enrichment was at least $+/-2*\sigma$ (e.g. p=0.05 assuming a normal distribution) of the wild-type value. We performed two replicates of each selection reported in this study to derive these figures and applied a cutoff threshold of 10 across the replicate experiments for inclusion in each analysis.

For every codon targeted our designs also included a synonymous variant to provide an internal experimental control. Thus 5% of the protein targeting cassettes encoded synonymous mutations that allow us to estimate confidence intervals for mutation effects using custom Python bootstrapping scripts. The enrichment data for each experiment was resampled with replacement 20000 to obtain 95% confidence interval estimations that were used to infer statistical significance of enrichment scores for each analysis presented in the manuscript.

Mutant Reconstructions and Growth Measurements

The AcrB T60N and Crp S28P and FolA F153R/W CREATE cassettes were ordered as separate gblocks from IDT, cloned and sequence verified. Each cassette was transformed into MG1655 and colony screened to identify a clone with the designed genomic edit. These strains (e.g. FIG. 21 and FIG. 22A-22C) were then subjected to the growth conditions from the pooled library selection as indicated. The growth curves were taken in triplicate for each condition in 100 µL in a 96 well plate reader set to measure absorbance at 600 nm. The plate was covered and water added to empty wells to reduce evaporation during the growth.

Software and Figure Generation

Circle plots were generated using Circos v0.67. Plots were generated in Python 2.7 using the matplotlib plotting libraries and figures were made using Adobe Illustrator CS5. Entropy scores for the FolA (FIG. 10A) were determined using the ProDy Python package and the Pfam accession PF00186 representative proteome alignment RP35.

Figures of the protein libraries and high fitness mutations were made using The PyMol Molecular Graphics System, Schrodinger, LLC. The following are the proteins and PDBs used in the figure generation: AcrB (3W9H, 4K7Q, 3AOC), Fis (3JR9), Ihf (1IHF), RNA polymerase (4KMU, 4IGC), Crp (3N4M), MarA (1BLO), and SoxR (2ZHG).

Example 29: Testing Edit-Barcode Correlation

Figures 27A, 27B:
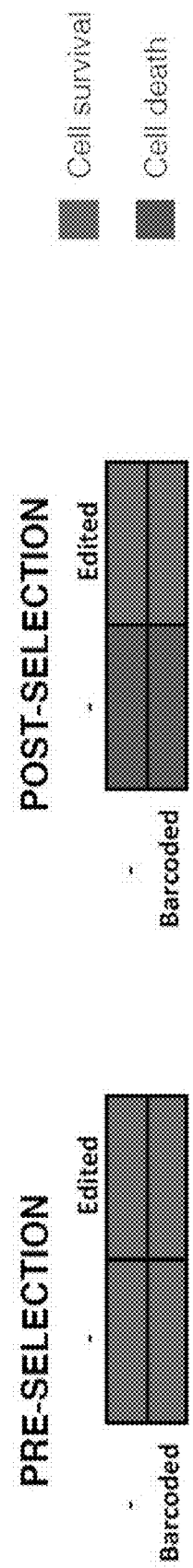

A strain expressing a low copy number plasmid (Ec23) which is a Cas9-pSIM5 dual vector, was tested using different gene editing cassettes (lacZ, xylA, and rhaA) and recorder cassettes with different barcodes and insertion sites (galK site 1, galK site 2, and galK site 3) (Summarized in FIG. 27A). The possible outcomes are depicted in FIG. 27B. Pre-selection, all combinations of edit/barcode/WT are possible. After selection, edits cells could be enriched whether they are barcoded or not in this experimental design.

The transformations were plated on selective media that allowed for enrichment of cells containing the gene edits. 30 colonies from each combination transformation were sequenced to determine if they contained the desired barcode.

FIG. 27C shows the results from the sequencing data. Two of the edit/barcode combinations were found in 100% of the tested colonies (30/30 colonies), and the other edit/barcode combination transformation was found in approximately 97% of tested colonies (29/30 colonies). The single colony that was not properly engineered contained the gene edit, but not the barcode.

Overall, 89 out of 90 tested colonies has the designed gene edit and barcode.

Example 30: Selectable Recording

Figure 28:
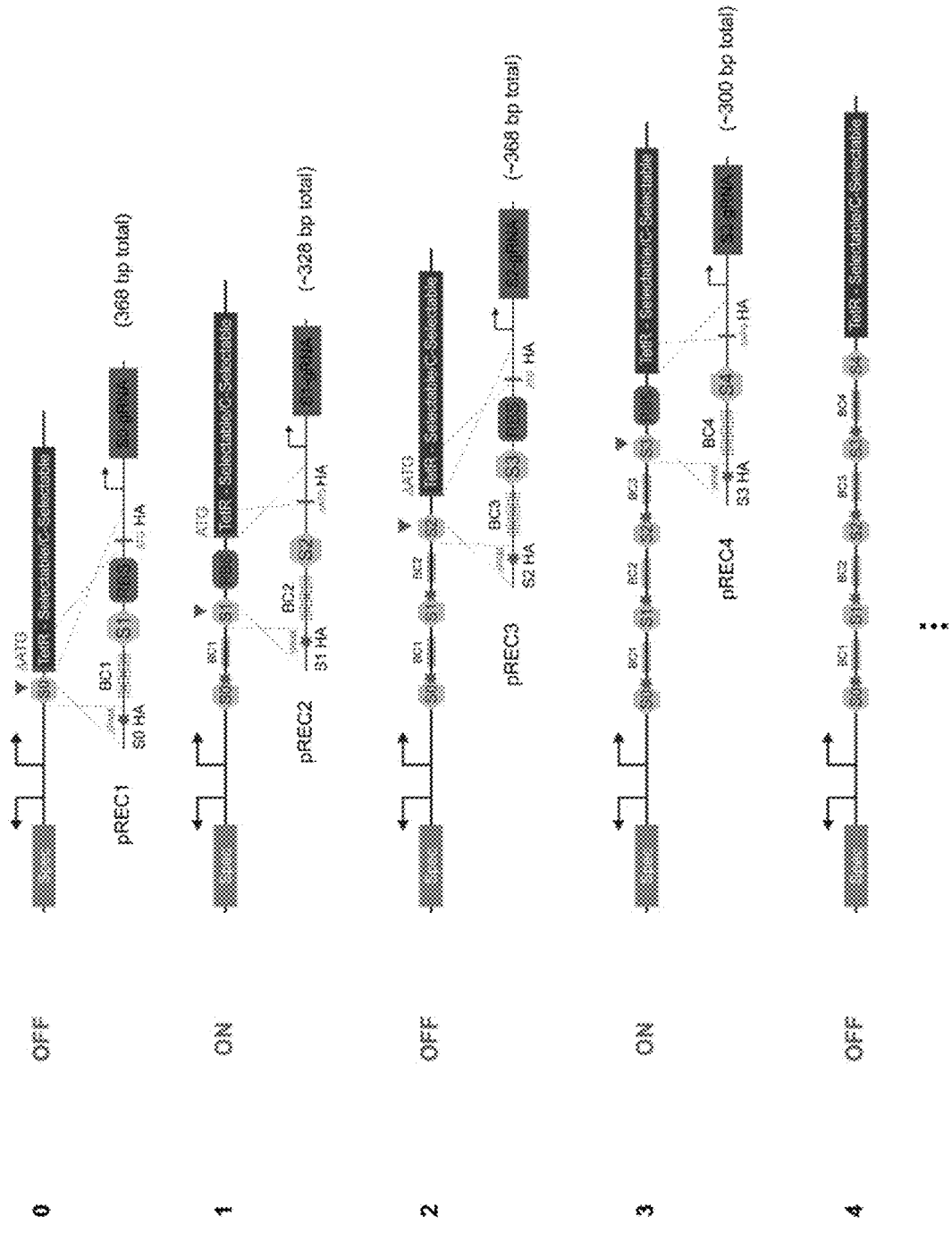
FIG. 28 depicts an example of a selectable recording strategy.

When a barcode is not selected for, it allows for enrichment of non-barcoded cells even if the corresponding gene edit is incorporated and selected for. FIG. 28 depicts an example strategy for selecting for the recording event (e.g., incorporation of the barcode by the recorder cassette), in addition to selecting for the editing cassette incorporation, thereby increasing the efficiency of recovering cells that have been both edited and barcoded.

As depicted in FIG. 28, sequences S0, S1, S2, etc. are designed to be targeted by the guide RNA associated with the recorder cassette of the next round. In the depicted example, in the first round of engineering, a PAM mutation, a barcode, S1 site, and regulatory elementary necessary to turn on a selectable marker are incorporated into the S0 site in the target region. This turns on the TetR selectable marker and allows for enrichment of barcoded mutants variants with the S1 site that have the first round PAM site deleted. In the second round of engineering, a new recorder cassette comprising a second PAM mutation, a second barcode, a S2 site, and a mutation that turns off the selectable marker is incorporated into the S1 site from the previous round. This allows for counter-selection of variants that have incorporated the second barcode and S2 site. The subsequent rounds continue to flip the selectable marker between an on and off state and using selection or counter-selection respectively to enrich the desired variants. The recorder cassette from each round is designed to incorporate into a unique sequence (e.g., S0, S1, etc.) that was incorporated in the previous round. This ensures that the last round of barcoding was successful so that all desired engineering steps are contained in the final product. The incorporation of PAM mutations at each step also helps ensure that the desired barcoded variants are selected for since cells having the unmodified PAM sequences will be killed as they can't escape CRISPR enzyme cleavage.

This strategy uses multiple methods to increase the efficiency of isolating desired variants that contain all of the engineered edits from each round of engineering. The PAM mutation, selectable marker switch, and unique landing site incorporated in each round separately increase efficiency and together increase efficiency as well. These tools allow for selection of each recording round and allow design of highly active recording guide RNAs. An array of equally spaced (or not equally spaced, depending on the design) barcodes is generated and facilitates downstream analysis such as sequencing the barcode array to determine which corresponding edits are incorporated throughout the genome.

Figure 29:
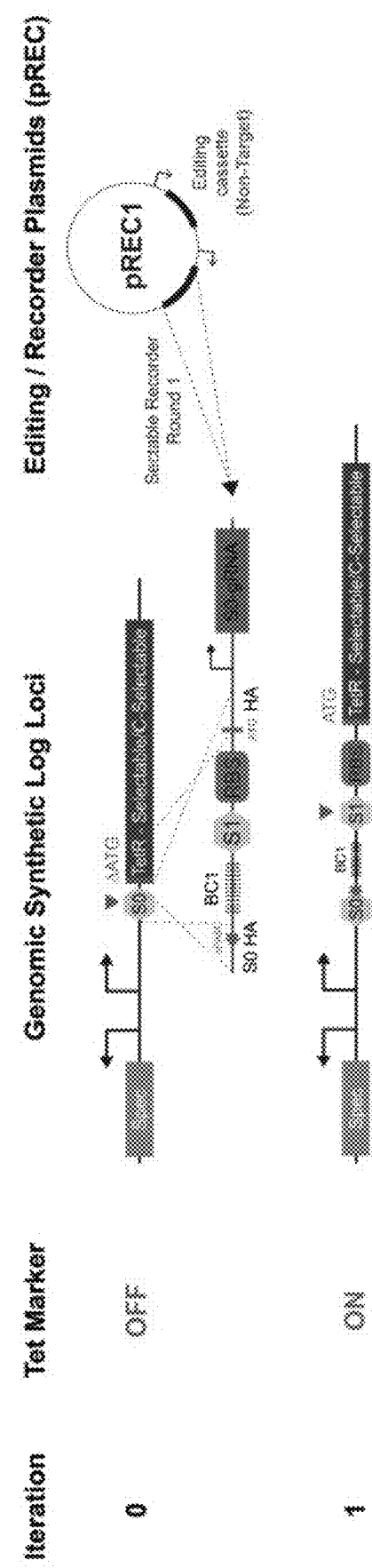
FIG. 29 depicts an example of a selectable recording strategy.

FIG. 29 depicts an experimental design to test the selectable recorder strategy described above. A plasmid (pREC1) containing an editing cassette and a recorder cassette was transformed into cells. The editing cassette either contained a non-targeting editing cassette, or a mutation that incorporated a mutation (not TS) or a temperature sensitive mutation (TS) into a target gene. The recorder cassette was designed to incorporate into the S0 site in the target gene that originally had the tetR selectable marker turned off. The recorder cassette also contained a PAM mutation that deleted the S0 PAM site, first barcode (BC1), a unique S1 site for the subsequent engineering round recording cassette to incorporate into, and a corrective mutation that will turn on the TetR selectable marker. A guide RNA on the recorder cassette that targets a PAM site in the S0 site (S0-gRNA) allows a CRISPR enzyme, in this case Cas9, to cleave the S0 site. The recorder cassette recombines into the cleaved S0 site. The PAM mutation is incorporated, which means the S0-gRNA can no longer target the S0 site, thereby killing WT cells and enriching for cells that received the barcode. The TetR selectable marker was also turned on, allowing further selection of the barcoded variant.

Figure 30A:
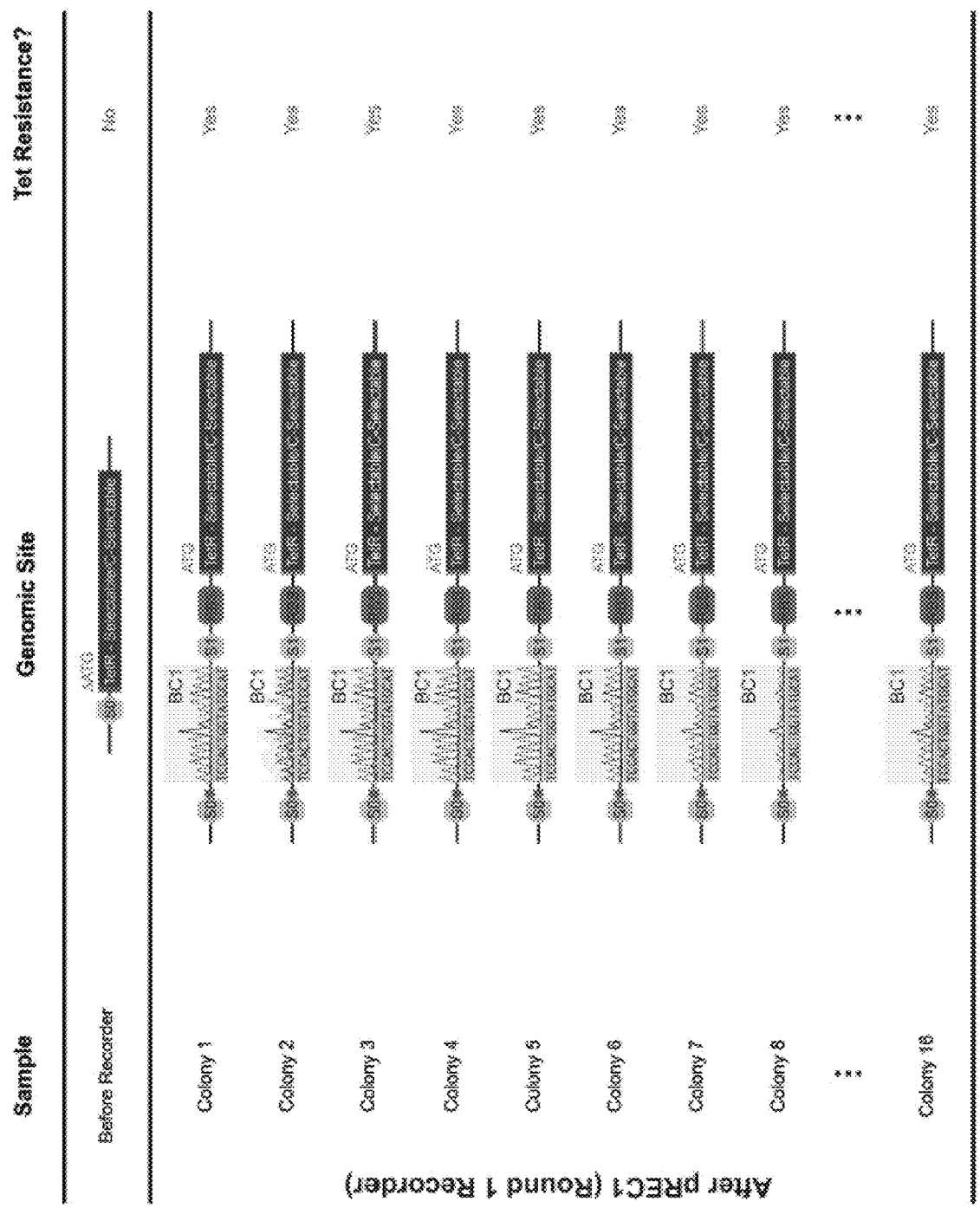
FIGS. 30A-30B depict data from a selectable recording experiment.
Figure 30B:
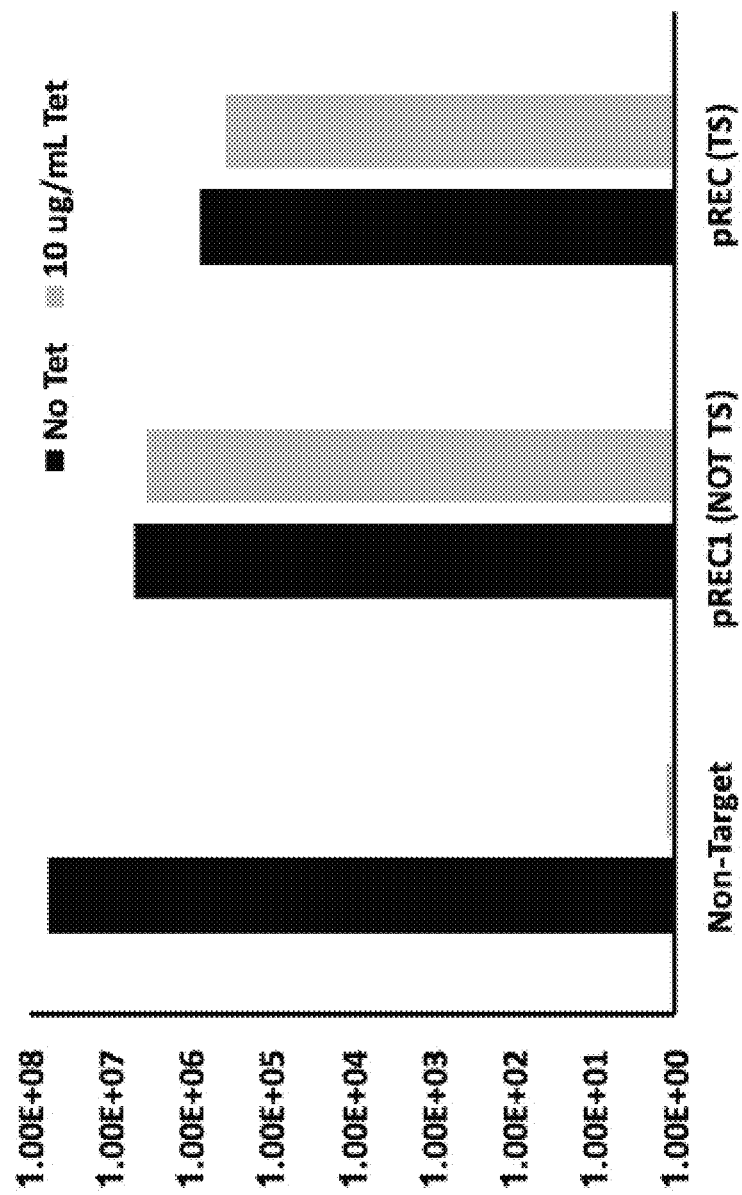

The data in FIGS. 30A and 30B show the results from the experiment described above and depicted in FIG. 29. Of the Tet Resistant colonies that were recovered from the transformation and engineering round, 16 were sequence and determined to all contain the designed barcode (FIG. 30A). FIG. 30B shows that the control cells that did not contain the recorder target site (non-target) did not survive the presence of Tet, while cells that contained the target site were successfully barcoded as evidences by the turning on of TetR, allowing cells to be selected on Tet containing media. The Tet resistant colonies were confirmed at the genomic site to have TetR gene turned on. These data showed that selectable recording was successful.

Example 31: Expression of MAD Nucleases

Wild-type nucleic acid sequences for MAD1-MAD20 include SEQ ID NOs 21-40, respectively. These MAD nucleases were codon optimized for expression in E. coli and the codon optimized sequences are listed as SEQ ID NO: 41-60, respectively (summarized in Table 2). Codon optimized MAD1-MAD20 were cloned into an expression construct comprising a constitutive or inducible promoter (e.g., T7 promoter SEQ ID NO: 83, or pBAD promoter SEQ ID NO: 81 or SEQ ID NO: 82) and an optional 6X-His tag (SEQ ID NO: 186). The generated MAD1-MAD20 expression constructs are provided as SEQ ID NOs: 61-80, respectively.

TABLE 2

| MAD nuclease | WT nucleic acid sequence | Codon optimized nucleic acid sequence | Amino acid sequence | Expression constructs |
|---|---|---|---|---|
| MAD1 | SEQ ID NO: 21 | SEQ ID NO: 41 | SEQ ID NO: 1 | SEQ ID NO: 61 |
| MAD2 | SEQ ID NO: 22 | SEQ ID NO: 42 | SEQ ID NO: 2 | SEQ ID NO: 62 |
| MAD3 | SEQ ID NO: 23 | SEQ ID NO: 43 | SEQ ID NO: 3 | SEQ ID NO: 63 |
| MAD4 | SEQ ID NO: 24 | SEQ ID NO: 44 | SEQ ID NO: 4 | SEQ ID NO: 64 |
| MAD5 | SEQ ID NO: 25 | SEQ ID NO: 45 | SEQ ID NO: 5 | SEQ ID NO: 65 |
| MAD6 | SEQ ID NO: 26 | SEQ ID NO: 46 | SEQ ID NO: 6 | SEQ ID NO: 66 |
| MAD7 | SEQ ID NO: 27 | SEQ ID NO: 47 | SEQ ID NO: 7 | SEQ ID NO: 67 |
| MAD8 | SEQ ID NO: 28 | SEQ ID NO: 48 | SEQ ID NO: 8 | SEQ ID NO: 68 |
| MAD9 | SEQ ID NO: 29 | SEQ ID NO: 49 | SEQ ID NO: 9 | SEQ ID NO: 69 |
| MAD10 | SEQ ID NO: 30 | SEQ ID NO: 50 | SEQ ID NO: 10 | SEQ ID NO: 70 |
| MAD11 | SEQ ID NO: 31 | SEQ ID NO: 51 | SEQ ID NO: 11 | SEQ ID NO: 71 |
| MAD12 | SEQ ID NO: 32 | SEQ ID NO: 52 | SEQ ID NO: 12 | SEQ ID NO: 72 |
| MAD13 | SEQ ID NO: 33 | SEQ ID NO: 53 | SEQ ID NO: 13 | SEQ ID NO: 73 |
| MAD14 | SEQ ID NO: 34 | SEQ ID NO: 54 | SEQ ID NO: 14 | SEQ ID NO: 74 |
| MAD15 | SEQ ID NO: 35 | SEQ ID NO: 55 | SEQ ID NO: 15 | SEQ ID NO: 75 |
| MAD16 | SEQ ID NO: 36 | SEQ ID NO: 56 | SEQ ID NO: 16 | SEQ ID NO: 76 |
| MAD17 | SEQ ID NO: 37 | SEQ ID NO: 57 | SEQ ID NO: 17 | SEQ ID NO: 77 |
| MAD18 | SEQ ID NO: 38 | SEQ ID NO: 58 | SEQ ID NO: 18 | SEQ ID NO: 78 |
| MAD19 | SEQ ID NO: 39 | SEQ ID NO: 59 | SEQ ID NO: 19 | SEQ ID NO: 79 |
| MAD20 | SEQ ID NO: 40 | SEQ ID NO: 60 | SEQ ID NO: 20 | SEQ ID NO: 80 |

Example 32: MAD2 and MAD7 Nucleases

MAD2 and MAD7 nucleases are nucleic acid-guided nuclease that can be used in the methods disclosed herein. Nucleases Mad2 (SEQ ID NO: 2) and Mad 7 (SEQ ID NO: 7) were cloned and transformed into cells. Editing cassettes designed to mutate a target site in a galK gene were designed with mutations, which allowed for white/red screening of successfully editing colonies. The editing cassettes also encoded a guide nucleic acid designed to target galK. The editing cassettes were transformed into E. coli cells expressing MAD2, MAD7, or Cas9. FIG. 31A shows the editing efficiency of Mad2 and Mad7 compared to Cas9 (SEQ ID NO: 110). FIG. 31B shows the transformation efficiency as evidenced by cell survival rates. In this example, the guide nucleic acid used with MAD2 and MAD7 comprised a scaffold-12 sequence and a guide sequence targeting galK. The guide nucleic acid used with Cas9 comprised a sequence compatible with the S. pyogenes Cas9.

Figure 32:
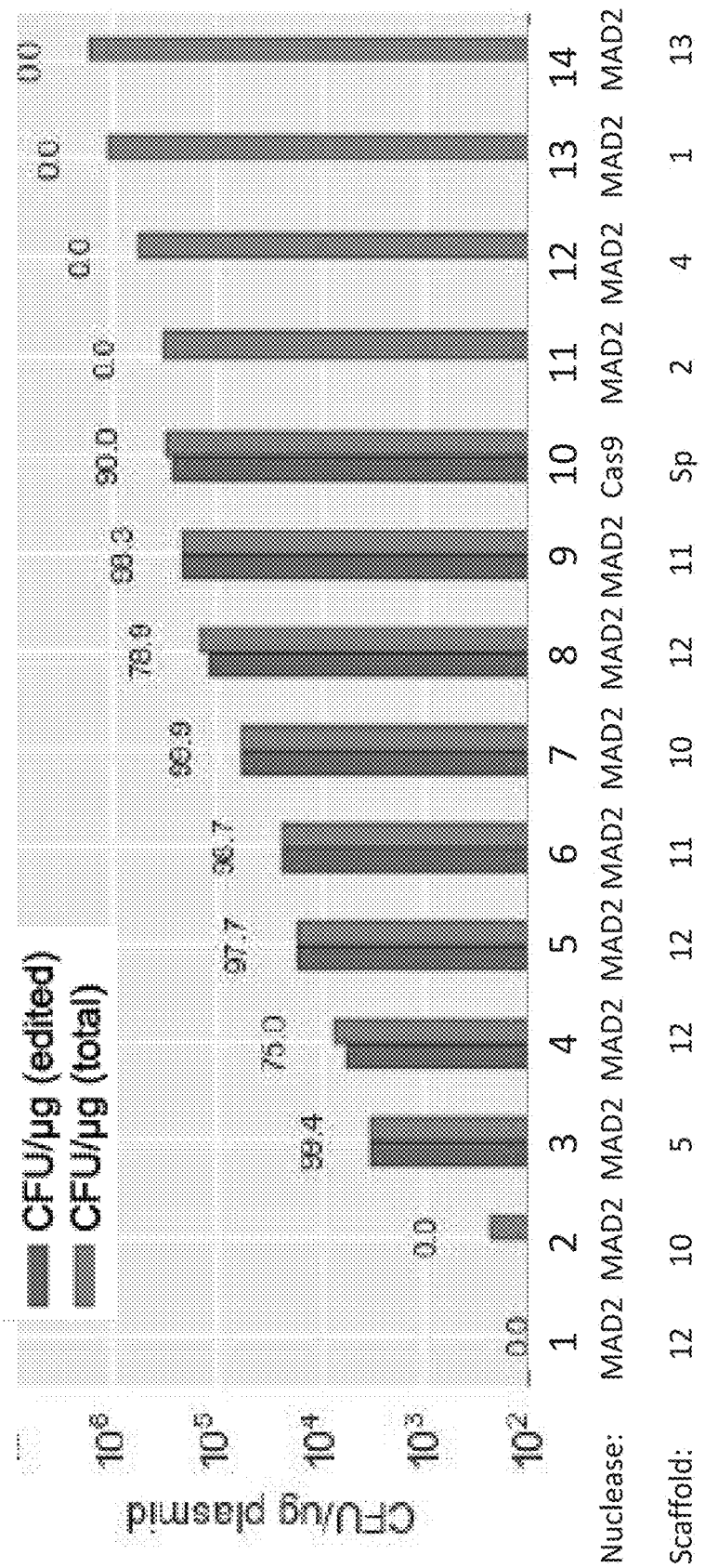
FIG. 32 depict editing efficiencies of the MAD2 nuclease with various guide nucleic acids.

FIG. 32 and Table 3 show more examples of gene editing using the MAD2 nuclease. In this experiment, different guide nucleic acid sequences were tested. The guide sequence of the guide nucleic acids targeted the galK gene as described above. The scaffold sequence of the guide nucleic acids were one of various sequences tested as indicated. Guide nucleic acids with scaffold-5, scaffold-10, scaffold-11, and scaffold-12 were able to form functional complexes with MAD2.

FIG. 33 and Table 4 show more examples of gene editing using the MAD7 nuclease. In this experiment, different guide nucleic acid sequences were tested. The guide sequence of the guide nucleic acids targeted the galK gene as described above. The scaffold sequence of the guide nucleic acids were one of various sequences tested as indicated. Guide nucleic acids with scaffold-10, scaffold-11, and scaffold-12 (e.g., FIG. 31A) were able to form functional complexes with MAD7. Amino acid sequences are provided in Table 2 and scaffolding sequences are provided in Table 3 and Table 4. Table 3 and Table 4 also provided the designed mutations in the editing cassettes that were used to mutate the galK target gene.

Further details and characterization of MAD2, MAD7, and other MAD nucleases are described in U.S. application Ser. No. 15/631,989, filed Jun. 23, 2017, and U.S. application Ser. No. 15/632,001, filed Jun. 23, 2017, each of which are incorporated herein in their entirety.

TABLE 3

| # | Nucleic acid-guided nuclease | Guide nucleic acid scaffold sequence | Editing sequence mutation | Target gene |
|---|---|---|---|---|
| 1 | MAD2 | Scaffold-12; SEQ ID NO: 95 | N89KpnI | galK |
| 2 | MAD2 | Scaffold-10; SEQ ID NO: 93 | L80** | galK |
| 3 | MAD2 | Scaffold-5; SEQ ID NO: 88 | L80** | galK |
| 4 | MAD2 | Scaffold-12; SEQ ID NO: 95 | D70KpnI | galK |
| 5 | MAD2 | Scaffold-12; SEQ ID NO: 95 | Y145** | galK |
| 6 | MAD2 | Scaffold-11; SEQ ID NO: 94 | Y145** | galK |
| 7 | MAD2 | Scaffold-10; SEQ ID NO: 93 | Y145** | galK |
| 8 | MAD2 | Scaffold-12; SEQ ID NO: 95 | L10KpnI | galK |
| 9 | MAD2 | Scaffold-11; SEQ ID NO: 94 | L80** | galK |
| 10 | SpCas9 | S. pyogenese gRNA | Y145** | galK |
| 11 | MAD2 | Scaffold-2; SEQ ID NO: 85 | Y145** | galK |
| 12 | MAD2 | Scaffold-4; SEQ ID NO: 87 | Y145** | galK |
| 13 | MAD2 | Scaffold-1; SEQ ID NO: 84 | L80** | galK |
| 14 | MAD2 | Scaffold-13; SEQ ID NO: 96 | Y145** | galK |

TABLE 4

| # | Nucleic acid-guided nuclease | Guide nucleic acid scaffold sequence | Editing sequence mutation | Target gene |
|---|---|---|---|---|
| 1 | MAD7 | Scaffold-1; SEQ ID NO: 84 | L80** | galK |
| 2 | MAD7 | Scaffold-2; SEQ ID NO: 85 | Y145** | galK |
| 3 | MAD7 | Scaffold-4; SEQ ID NO: 87 | Y145** | galK |
| 4 | MAD7 | Scaffold-10; SEQ ID NO: 93 | Y145** | galK |
| 5 | MAD7 | Scaffold-11; SEQ ID NO: 95 | L80** | galK |

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING

TABLE 5

| SEQ ID NO | Sequence |
|---|---|
| SEQ ID NO: 1 | MGKMYYLGLDIGTNSVGYAVTDPSYHLLKFKGEPMWGAHVFAAGNQSAERRSFRTSRRRLDRRQQRVKLV QEIFAPVISPIDPRFFIRLHESALWRDDVAETDKHIFFNDPTYTDKEYYSDYPTIHHLIVDLMESSEKHDPRLVY LAVAWLVAHRGHFLNEVDKDNIGDVLSFDAFYPEFLAFLSDNGVSPWVCESKALQATLLSRNSVNDKYKAL KSLIFGSQKPEDNFDANISEDGLIQLLAGKKVKVNKLFPQESNDASFTLNDKEDAIEEILGTLTPDECEWIAHIR RLFDWAIMKHALKDGRTISESKVKLYEQHHHDLTQLKYFVKTYLAKEYDDIFRNVDSETTKNYVAYSYHVK EVKGTLPKNKATQEEFCKYVLGKVKNIECSEADKVDFDEMIQRLTDNSFMPKQVSGENRVIPYQLYYYELKT ILNKAASYLPFLTQCGKDAISNQDKLLSIMTFRIPYFVGPLRKDNSEHAWLERKAGKIYPWNFNDKVDLDKSE EAFIRRMTNTCTYYPGEDVLPLDSLIYEKFMILNEINNIRIDGYPISVDVKQQVFGLFEKKRRVTVKDIQNLLLS LGALDKHGKLTGIDTTIHSNYNTYHHFKSLMERGVLTRDDVERIVERMTYSDDTKRVRLWLNNNYGTLTAD DVKHISRLRKHDFGRLSKMFLTGLKGVHKETGERASILDFMWNTNDNLMQLLSECYTFSDEITKLQEAYYA KAQLSLNDFLDSMYISNAVKRPIYRTLAVVNDIRKACGTAPKRIFIEMARDGESKKKRSVTRREQIKNLYRSIR KDFQQEVDFLEKILENKSDGQLQSDALYLYFAQLGRDMYTGDPIKLEHIKDQSFYNIDHIYPQSMVKDDSLD NKVLVQSEINGEKSSRYPLDAAIRNKMKPLWDAYYNHGLISLKKYQRLTRSTPFTDDEKWDFINRQLVETRQ STKALAILLKRKFPDTEIVYSKAGLSSDFRHEFGLVKSRNINDLHHAKDAFLAIVTGNVYHERFNRRWFMVN QPYSVKTKLTFTHSIKNGNFVAWNGEEDLGRIVKMLQNKNTIHFTRFSFDRKEGLFDIQPLKASTGLVPRKA GLDVVKYGGYDKSTAAYYLLVRFTLEDKKTQHKLMMIPVEGLYKARIDHDKEFLTDYAQTTISEILQKDKQ KVININMFPMGTRHIKLNSMISIDGFYLSIGGKSSKGKSVLCHAMVPLIVPHKIECYIKAMESFARKFKENNKLRI VEKFDKITVEDNLNYELFLQKLQHPYNKFFSTQFDVLTNGRSTFTKLSPEEQVQTLLNILSIFKTCRSSGCD LKSINGSAQAARIMISADLTGLSKKYSDIRLVEQSASGLFVSKSQNLLEYL* |
| SEQ ID NO: 2 | MSSLTKFTNKYSKQLTIKNELIPVGKTLENIKENGLIDGDEQLNENYQKAKIIVDDFLRDFINKALNNTQIGNW RELADALNKEDEDNIEKLQDKIRGIIVSKFETFDLFSSYSIKDKIIDDDNDVEEEELDLGKKTSSFKYIFKKN LFKLVLPSYLKTTNQDKLKIISSFDNFSTYFRGFFENRKNIFTKKPISTSIAYRIVHDNFPKFLDNIRCFNVWQTE CPQLIVKADNYLKSKNVIAKDKSLANYFTVGAYDYFLSQNGIDFYNNIIGGLPAFAGHEKIQGLNEFINQECQ KDSELKSKLKNRHAPKMAVLFKQILSDREKSFVIDEFESDAQVIDAVKNFYAEQCKDNNVIFNLLNLIKNIAF LSDDELDGIPIEGKYLSSVSQKLYSDWSKLRNDIEDSANSKQGNKELAKKIKTNKGDVEKAISKYEFSLSELNS IVHDNTKFSDLLSCTLHKVASEKLVKVNEGDWPKHLKNNEEKQKIKEPLDALLEIYNTLLIFNCKSFNKNGNF YVDYDRCINELSSVVYLYNKTRNYCTKKPYNTDKFKLNFNSPQLGEGFSKSKENDCLTLLFKKDDNYYVGII RKGAKINFDDTQAIADNTDNCIFKMNYFLLKDAKKFIPKCSIQLKEVKAHFKKSEDDYILSDKEKFASPLVIKK STFLLATAHVKGKKGNIKKFQKEYSKENPTEYRNSLNEWIAFCKEFLKTYKAATIFDITTLKKAEEYADIVEF YKDVDNLCYKLEFCPIKTSFIENLIDNGDLYLFRINNKDFSSKSTGTKNLHFTLYLQAIFDERNLNNPTIMLNGG AELFYRKESIEQKNRITHKAGSILVNKVCKDGTSLDDKIRNEIYQYENKFIDTLSDEAKKVLPNVIKKEATHDI TKDKRFTSDKFFFHCPLTINYKEGDTKQFNNEVLSFLRGNPDINIIGIDRGERNLIYVTVINQKGEILDSVSFNT VTNKSSKIEQTVDYEEKLAVREKERIEAKRSWDSISKIATLKEGYLSAIVHEICLLMIKHNAIVVLENLNAGFK RIRGGLSEKSVYQKFEKMLINKLNYFVSKKESDWNKPSGLLNGLQLSDQVPSFEKLGIQSGFIFYVPAAYTSKI DPTTGFANVLNLSKVRNVDAIKSFFSNFNEISYSKKEALFKFSFDLDSLSKKGFSSFVKFSKSKWNVYTFGERII KPKNKQGYREDKRINLTFEMKKLLNEYKVSFDLENNLIPNLTSANLKDTFWKELFFIFKTTLQLRNSVTNGKE DVLISPVKNAKGEFFVSGTHNKTLPQDCDANGAYHIALKGLMILERNNLVREEKDTKKIMAISNVDWFEYVQ KRRGVL* |
| SEQ ID NO: 3 | MNNYDEFTKLYPIQKTIRFELKPQGRTMEHLETFNFFEEDRDRAEKYKILKEAIDEYHKKFIDEHLTNMSLDW NSLKQISEKYYKSREEKDKKVFLSEQKRMRQEIVSEFKKDDRFKDLFSKKLFSELLKEEIYKKGNHQEIDALK SFDKFSGYFIGLHENRKNMYSDGDEITAISNRIVNENFPKFLDNLQKYQEARKKYPEWIIKAESALVAHNIKM DEVFSLEYFNKVLNQEGIQRYNLALGGYVTKSGEKMMGLNDALNLAHQSEKSSKGRIHMTPLFKQILSEKES FSYIPDVFTEDSQLLPSIGGFFAQIENDKDGNIFDRALELISSYAEYDTERIYIRQADINRVSNVIFGEWGTLGGL MREYKADSINDINLERTCKKVDKWLDSKEFALSDVLEAIKRTGNNDAFNEYISKMRTAREKIDAARKEMKFI SEKISGDEESIHIIKTLLDSVQQFLHFFNLFKARQDIPLDGAFYAEFDETNKVLQYDFKIVPLYNKVRNYLTKNNLNT KKIKLNFKNPTLANGWDQNKVYDYASLIFLRDGNYYLGIINPKRKKNIKFEQGSGNGPFYRKMVYKQIPGPN KNLPRVFLTSTKGKKEYKPSKEIIEGYEADKHIRGDKFDLDFCHKLLIDFFKESIEKHKDWSKFNPYFSPTESYG DISEFYLDVEKQGYRMHFENISAETIDEYVEKGDLFLFQIYNKDFVKAATGKKDMHTIYWNAAFSPENLQDV VVKLNGEAELFYRDKSDIKEIVHREGEILVNRTYNGRTPVPDKPIHKKLTDYHNGRTKDLGEAKEYLDKVRYF KAHYDITKDRRYLNDKIYFHVPLTLNFKANGKKNLNKMVIEKFLSDEKAHIIGIDRGERNLLYYSIIDRSGKII DQQSLNVIDGFDYREKLNQREIEMKDARQSWNAIGKIKDLKEGYLSKAVHEITKMAIQYNAIVVMEELNYGF KRGRFKVEKQIYQKFENMLIDKMNYLVFKDAPDESPGGVLNAYQLTNPLESFAKLGKQTGILFYVPAAYTSK IDPTTGFVNLFNTSSKTNAQERKEFLQKFESISYSAKDGGIFAFAFDYRKFGTSKTDHKNVWTAYTNGERMR YIKEKKRNELFDPSKEIKEALTSSGIKYDGGQNILPDILRSNNNGLIYTMYSSFIAAIQMRVYDGKEDYIISPIKN SKGEFFRTDPKRRELPIDADANGAYNIALRGELTMRAIAEKFDPDSEKMAKLELKHKDWFEFMQTRGD* |
| SEQ ID NO: 4 | MTKTFDSEFFNLYSLQKTVRFELKPVGETASFVEDFKNEGLKRVVSEDERRAVDYQKVKEIIDDYHRDFIEES LNYFPEQVSKDALEQAFHLYQKLKAAKVEEREKALKEWEALQKLLREKVVKCFSDSNKARFSRIDKKELIK EDLINWLVAQNREDDIPTVETFNNFTTYFTGFHENRKNIYSKDDHATAISFRLIHENLPKFFDNVISFNKLKEG FPELKFDKVKEDLEVDYDLKHAFEIEYFVNFVTQAGIDQYNYLLGGKTLEDGTKKQGMNEQINLFKQQQTR DKARQIPKLIPLFKQILSERTESQSFIPKQFESDQELFDSLQKLHNNCQDKFTVLQQAILGLAEADLKKVFIKTS DLNALSNTIFGNYSVFSDALNLYEKSLKTKKAQEAFEKLPAHSIHDLIQYLEQFNSSLDAEKQQSTDTVLNYFI KTDELYSRFIKSTSEAFTQVQPLFELEALSSKRRPPESEDEGAKGQEGFEQIKRIKAYLDTLMEAVHFAKPLYL VKGRKMIEGLDKDQSFYEAFEMAYQELESLIIPIYNKARSYLSRKPFKADKFKINFDNNTLLSGWDANKETAN ASILFKKDGLYYLGIMPKGKTFLFDYFVSSEDSEKLKQRRQKTAEEEALAQDGESYFEKIRYKLLPGASKMLPK VFFSNKNIGFYNPSDDILRIRNTASHTKNGTPQKGHSKVEFNLNDLFKSFSPYSKGKPNLHTLYWKALFEEANL NNVVAKLNGEAEIFFRRHSIKASDKVVHPANQAIDNKNPHTEKTQSTFEYDLVKDKRYTQDKFFFHVPISLNF KAQGVSKFNDKVNGFLKGNPDVNIIGIDRGERHLLYFTVVNQKGEILVQESLNTLMSDKGHVNDYQQKLDK KEQERDAARKSWTTVENIKELKEGYLSHVVKLAHLIIKYNAIVCLEDLNFGFKRGRFKVEKQVYQKFEKAL IDKLNYLVPFKEKELGEVGHYLTAYQLTAPFESFKKLGKQSGILFYVPADYTSKIDPTTGFVNFLDLRYQSVEK |

TABLE 5-continued

| SEQ ID NO | Sequence |
|---|---|
| | AKQLLSDFNAIRFNSVQNYFEFEIDYKKLTPKRKVGTQSKWVICTYGDVRYQNRRNQKGHWETEEVNVTEK<br>LKALFASDSKTTTVIDYANDDNLIDVILEQDKASFFKELLWLLKLTMTLRHSKIKSEDDFILSPVKNEQGEFYD<br>SRKAGEVWPKDADANGAYHIALKGLWNLQQINQWEKGKTLNLAIKNQDWFSFIQEKPYQE* |
| SEQ ID NO: 5 | MHTGGLLSMDAKEFTGQYPLSKTLRFELRPIGRTWDNLEASGYLAEDRHRAECYPRAKELLDDNHRAFLNR<br>VLPQIDMDWHPIAEAFCKVHKNPGNKELAQDYNLQLSKRRKEISAYLQDADGYKGLFAKPALDEAMKIAKE<br>NGNESDIEVLEAFNGFSVYFTGYHESRENIYSDEDMVSVAYRITEDNFPRFVSNALIFDKLNESHPDIISEVSGN<br>LGVDDIGKYFDVSNYNNFLSQAGIDDYNHIIGGHTTEDGLIQAFNVVLNLRHQKDPGFEKIQFKQLYKQILSV<br>RTSKSYIPKQFDNSKEMVDCICDYVSKIEKSETVERALKLVRNISSFDLRGIFVNKKNLRILSNKLIGDWDAIET<br>ALMHSSSSENDKKSVYDSAEAFTLDDIFSSVKKFSDASAEDIGNRAEDICRVISETAPFINDLRAVDLDSLNDD<br>GYEAAVSKIRESLEPYMDLFHELEIFSVGDEFPKCAAFYSELEEVSEQLIEIIPLFNKARSFCTRKRYSTDKIKVN<br>LKFPTLADGWDLNKERDNKAAILRKDGKYYLAILDMKKDLSSIRTSDEDESSFEKMEYKLLPSPVKMLPKIF<br>VKSKAAKEKYGLTDRMLECYDKGMHKSGSAFDLGFCHELIDYYKRCIAEYPGWDVFDFKFRETSDYGSMK<br>EFNEDVAGAGYYMSLRKIPCSEVYRLLDEKSIYLFQIYNKDYSENAHGNKNMHTMYWEGLFSPQNLESPVF<br>KLSGGAELFFRKSSIPNDAKTVHPKGSVLVPRNDVNGRRIPDSIYRELTRYFNRGDCRISDEAKSYLDKVKTK<br>KADHDIVKDRRFTVDKMMFHVPIAMNFKAISKPNLNKKVIDGIIDDQDLKIIGIDRGERNLIYVTMVDRKGNI<br>LYQDSLNILNGYDYRKALDVREYDNKEARRNWTKVEGIRKMKEGYLSLAVSKLADMIIENNAIIVMEDLNH<br>GFKAGRSKIEKQVYQKFESMLINKLGYMVLKDKSIDQSGGALHGYQLANHVTTLASVGKQCGVIFYIPAAFT<br>SKIDPTTGFADLFALSNVKNVASMREFFSKMKSVIYDKAEGKFAFTFDYLDYNVKSECGRTLWTVYTVGERF<br>TYSRVNREYVRKVPTDIIYDALQKAGISVEGDLRDRIAESDGDTLKSIFYAFKYALDMRVENREEDYIQSPVK<br>NASGEFFCSKNAGKSLPQDSDANGAYNIALKGILQLRMLSEQYDPNAESIRLPLITNKAWLTFMQSGMKTWK<br>N* |
| SEQ ID NO: 6 | MDSLKDFTNLYPVSKTLRFELKPVGKTLENIEKAGILKEDEHRAESYRRVKKIIDTYHKVFIDSSLENMAKMG<br>IENEIKAMLQSFCELYKKDHRTEGEDKALDKIRAVLRGLIVGAFTGVCGRRENTVQNEKYESLFKEKLIKEILP<br>DFVLSTEAESLPFSVEEATRSLKEFDSFTSYFAGFYENRKNIYSTKPQSTAIAYRLIHENLPKFIDNILVFQKIKE<br>PIAKELEHIRADFSAGGYIKKDERLEDIFSLNYYIHVLSQAGIEKYNALIGKIVTEGDGEMKGLNEHINLYNQQ<br>RGREDRLPLFRPLYKQILSDREQLSYLPESFEKDEELLRALKEFYDHIAEDILGRTQQLMTSISEYDLSRIYVRN<br>DSQLTDISKKMLGDWNAIYMAREREAYDHEQAPKRITAKYERDRIKALKGEESISLANLNSCIAFLDNVRDCR<br>VDTYLSTLGQKEGPHGLSNLVENVFASYHEAEQLLSFPYPEENNLIQDKDNVVLIKNLLDNISDLQRFLKPLW<br>GMGDEPDKDERFYGEYNYIRGALDQVIPLYNKVRNYLTRKPYSTRKVKLNFGNSQLLSGWDRNKEKDNSC<br>VILRKGQNFYLAIMNNRHKRSFENKVLPEYKEGEPYFEKMDYKFLPDPNKMLPKVFLSKKGIEIYKPSPKLLE<br>QYGHGTHKKGDTFSMDDLHELIDFFKHSIEAHEDWKQFGFKFSDTATYENVSSFYREVEDQGYKLSFRKVSE<br>SYVYSLIDQGKLYLFQIYNKDFSPCSKGTPNLHTLYWRMLFDERNLADVIYKLDGKAEIFFREKSLKNDHPTH<br>PAGKPIKKKSRQKKGEESLFEYDLVKDRHYTMDKFQFHVPITMNFKCSAGSKVNDMVNAHIREAKDMHVIG<br>IDRGERNLLYICVIDSRGTILDQISLNTINDIDYHDLLESRDKDRQQERRNWQTIEGIKELKQGYLSQAVHRIAE<br>LMVAYKAVVALEDLNMGFKRGRQKVESSVYQQFEKQLIDKLNYLVDKKKRPEDIGGLLRAYQFTAPFKSFK<br>EMGKQNGFLFYIPAWNTSNIDPTTGFVNLFHAQYENVDKAKSFFQKFDSISYNPKKDWFEFAFDYKNFTKKA<br>EGSRSMWILCTHGSRIKNFRNSQKNGQWDSEEFALTEAFKSLFVRYEIDYTADLKTAIVDEKQKDFFVDLLKL<br>FKLTVQMRNSWKEKDLDYLISPVAGADGRFFDTREGNKSLPKDADANGAYNIALKGLWALRQIRQTSEGGK<br>LKLAISNKEWLQFVQERSYEKD* |
| SEQ ID NO: 7 | MNNGTNNFQNFIGISSLQKTLRNALIPTETTQQFIVKNGIIKEDELRGENRQILKDIMDDYYRGFISETLSSIDDI<br>DWTSLFEKMEIQLKNGDNKDTLIKEQTEYRKAIHKKFANDDRFKNMFSAKLISDILPEFVIHNNNYSASEKEE<br>KTQVIKLFSRFATSFKDYFKNRANCFSADDISSSSCHRIVNDNAEIFFSNALVYRRIVKSLSNDDINKISGDMKD<br>SLKEMSLEEIYSYEKYGEFITQEGISFYNDICGKVNSFMNLYCQKNKENKNLYKLQKFDSLDLIAEYPYEVP<br>YKFESDEEVYQSVNGFLDNISSKHIVERLRKIGDNYNGYNLDKIYIVSKFYESVSQKTYRDWETINTALEIHYN<br>NILPGNGKSKADKVKKAVKNDLQKSITEINELVSNYKLCSDDNIKAETYIHEISHILNNFEAQELKYNPEIHLV<br>ESELKASELKNVLDVIMNAFHWCSVFMTEELVDKDNNFYAELEEIYDEIYPVISLYNLVRNYVTQKPYSTKKI<br>KLNFGIPTLADGWSKSKEYSNNAIILMRDNLYYLGIFNAKNPKDDKKIIEGNTSENKGDYKKMIYNLLPGNK<br>MIPKVFLSSKTGVETYKPSAYILEGYKQNKHIKSSKDFDITFCHDLIDYFKNCIAIHPEWKNFGFDFSDTSTYED<br>ISGFYREVELQGYKIDWTYISEKDIDLLQEKGQLYLFQIYNKDFSKKSTGNDNLHTMYLKNLFSEENLKDIVL<br>KLNGEAEIFFRKSSIKNPIIHKKGSILVNRTYEAEEKDQFGNIQIVRKNIPENIYQELYKYFNDKSDKELSDEAA<br>KLKNVVGHHEAATNIVKDYRYTYDKYFLHMPITINFKANKTGFNILRIQYIAKEKDLHVIGIDRGERNLIYV<br>SVIDTCGNIVEQKSFNIVNGYDYQIKLKQQEGARQIARKEWKEIGKIKEIKEGYLSLVIHEISKMVIKYNAIIAM<br>EDLSYGFKKGRFKVERQVYQKFETMLINKLNYLVFKDISITENGGLLKGYQLTYIPDKLKNVGHQCGCIFYVP<br>AAYTSKIDPTTGFVNIFKFKDLTVDAKREFIKKFDSIRYDSEKNLFCFTFDYNNFITQNTVMSKSSWSVYTYGV<br>RIKRRFVNGRFSNESDTIDITKDMEKTLEMTDINWRDGHDLRQDIIDYEIVQHIFEIFRLTVQMRNSLSELEDR<br>DYDRLISPVLNENNIFYDSAKAGDALPKDADANGAYCIALKGLYEIKQITENWKEDGKFSRDKLKISNKDWF<br>DFIQNKRYL* |
| SEQ ID NO: 8 | MTNKFTNQYSLSKTLRFELIPQGKTLEFIQEKGLLSQDKQRAESYQEMKKTIDKFHKYFIDLALSNAKLTHLE<br>TYLELYNKSAETKKEQKFKDLKKVQDNLRKEIVKSFSDGDLKKELITVELEKWFENNEQKDIYF<br>DEKFKTFTTYFTGFHQNRKNMYSVEPNSTAIAYRLIHENLPKFLENAKAFEKIKQVESLQVNFRELMGEFGDE<br>GLIFVNELEEMFQINYYNDVLSQNGITIYNSIISGFTKNDIKYKGLNEYINNYNQTKDKKDRLPKLKQLYKQIL<br>SDRISLSFLPDAFTDGKQVLKAIFDFYKINLLSYTIEGQEESQNLLLLIRQTIENLSSFDTQKIYLKNDTHLTTISQ<br>QVFGDFSVFSTALNYWYETKVNPKFETEYSKANEKKREILDKAKAVFLDKQDYFSIAFLQVLSEYILTLDHTS<br>DIVKKHSSNCIADYFKNHFVAKKENETDKTFDFIANITAKYQCIQGILENADQYEDELKQDQKLIDNLKFFLD<br>AILELLHFIKPLHLKSESITEKDTAFYDVFENYYEALSLLTPLYNMVRNYVTQKPYSTEKIKLNFENAQLLNG<br>WDANKEGDYLTTILKKDGNYFLAIMDKKHKNAFQKFPEGKENYEKMVYKLLPGVNKMLPKVFFSNKNIAY<br>FNPSKELLENYKKETHKKGDTFNLEHCHTLLIDFFKDSLNKHEDWKYFDFQFSETKSYQDLSGFYREVEHQGY<br>KINFKNIDSEYIDGLVNEGKLFLFQIYSKDFSPFSKGKPNMHTLYWKALFEEQNLQNVIYKLNGQAEIFFRKAS<br>IKPKNIILHKKKIKIAKKHFIDKKTKTSEIVPVQTIKNLNMYYQGKISEKELTQDDLRYIDNFSIFNEKNKTIDIIK<br>DKRFTVDKFQFHVPITMNFKATGGSYINQTVLEYLQNNPEVKIIGLDRGERHLVYLTLIDQQGNILKQESLNTI<br>TDSKISTPYHKLLDNKENERDLARKNWGTVENIKELKEGYISQVVHKIATLMLEENAIVVMEDLNFGFKRGR<br>FKVEKQIYQKLEKMLIDKLNYLVLKDKQPQELGGLYNALQLTNKFESFQKMGKQSGFLFYVPAWNTSKIDP |

TABLE 5-continued

| SEQ ID NO | Sequence |
|---|---|
| | TTGFVNYFYTKYENVDKAKAFFEKFEAIRFNAEKKYFEFEVKKYSDFNPKAEGTQQAWTICTYGERIETKRQ<br>KDQNNKFVSTPINLTEKIEDFLGKNQIVYGDGNCIKSQIASKDDKAFFETLLYWFKMTLQMRNSETRTDIDYL<br>ISPVMNDNGTFYNSRDYEKLENPTLPKDADANGAYHIAKKGLMLLNKIDQADLTKKVDLSISNRDWLQFVQ<br>KNK* |
| SEQ ID NO: 9 | MEQEYYLGLDMGTGSVGWAVTDSEYHVLRKHGKALWGVRLFESASTAEERRMFRTSRRRLDRRNWRIEIL<br>QEIFAEEISKKDPGFFLRMKESKYYPEDKRDINGNCPELPYALFVDDDFTKDYHKKFPTIYHLRKMLMNTEE<br>TPDIRLVYLAIHHMMKHRGHFLLSGDINEIKEFGTTFSKLLENIKNEELDWNLELGKEEYAVVESILKDNMLN<br>RSTKKTRLIKALKAKSICEKAVLNLLAGGTVKLSDIFGLEELNETERPKISFADNGYDDYIGEVENELGEQFYII<br>ETAKAVYDWAVLVEILGKYTSISEAKVATYEKHKSDLQFLKKIVRKYLTKEEYKDIFVSTSDKLKNYSAYIG<br>MTKINGKKVDLQSKRCSKEEFYDFIKKNVLKKLEGQPEYEYLKEELERETFLPKQVNRDNGVIPYQIHLYELK<br>KILGNLRDKIDLIKENEDKLVQLFEFRIPYYVGPLNKIDDGKEGKFTWAVRKSNEKIYPWNFENVVDIEASAE<br>KFIRRMTNKCTYLMGEDVLPKDSLLYSKYMVLNELNNVKLDGEKLSVELKQRLYTDVFCKYRKVTVKKIK<br>NYLKCEGIISGNVEITGIDGDFKASLTAYHDFKEILTGTELAKKDKENIITNIVLFGDDKKLLKKRLNRLYPQIT<br>PNQLKKICALSYTGWGRFSKKFLEEITAPDPETGEVWNIITALWESNNNLMQLLSNEYRFMEEVETYNMGKQ<br>TKTLSYETVENMYVSPSVKRQIWQTLKIVKELEKVMKESPKRVFIEMAREKQESKRTESRKKQLIDLYKACK<br>NEEKDWVKELGDQEEQKLRSDKLYLYYTQKGRCMYSGEVIELDLWDNTKYDIDHIYPQSKTMDDSLNNR<br>VLVKKKYNATKSDKYPLNENIRHERKGFWKSLLDGGFISKEKYERLIRNTELSPEELAGFIERQIVETRQSTKA<br>VAEILKQVFPESEIVYKAGTVSRFRKDFELLKVREVNDLHHAKDAYLNIVVGNSYYVKFTKNASWFIKENP<br>GRTYNLKKMFTSGWNIERNGEVAWEVGKKGTIVTVKQIMNKNNILVTRQVHEAKGGLFDQQIMKKGKGQI<br>AIKETDERLASIEKYGGYNKAAGAYFMLVIESDKKGKTIRTIEFIPLYLKNKIESDESIALNFLEKGRGLKEPKI<br>LLKKIKIDTLFDVDGFKMWLSGRTGDRLLFKCANQLILDEKIIVTMKKIVKFIQRRQENRELKLSDKDGIDNE<br>VLMEIYNTFVDKLENTVYRIRLSEQAKTLIDKQKEFERLSLEDKSSTLFEILHIFQCQSSAANLKMIGGPGKAGI<br>LVMNNNISKCNKISIIINQSPTGIFENEIDLLK |
| SEQ ID NO: 10 | MNKFENFTGLYPISKTLRFELIPQGKTLEYIEKSEILENDNYRAEKYEEVKDIIDGYHKWFINETLHDLHINWSE<br>LKVALENNRIEKSDASKKELQRVQKIKREEIYNAFIEHEAFQYLFKENLLSDLLPIQIEQSEDLDAEKKKQAVE<br>TFNRFSTYFTGFHENRKNIYSKEGISTSVTYRIVHDNFPKFLENMKVFEILRNECPEVISDTANELAPFIDGVRIE<br>DIFLIDFFNSTFSQNGIDYYNRILGGVTTETGEKYRGINEFTNLYRQQHPEFGKSKKATKMVVLFKQILSDRDT<br>LSFIPEMFGNDKQVQNSIQLFYNREISQFENEGVKTDVCTALATLTSKIAEFDTEKIYIQQQPELPNVSQRLFGSW<br>NELNACLFKYAELKFGTAEKVANRKKIDKWLKSDLFSFTELNKALEFSGKDERIENYFSETGIFAQLVKTGFD<br>EAQSILETEYTSEVHLKDQQTDIEKIKTFLDALQNLMHLLKSLCVSEEADRDAAFYNEFDMLYNQLKLVVPL<br>YNKVRNYITQKLFRSDKIKIYFENKGQFLGGWVDSQTENSDNGTQAGGYIFRKENVINEYDYYLGICSDPKLF<br>RRTTIVSENDRSSFERLDYYQLKTASVYGNSYCGKHPYTEDKNELVNSIDRFVHLSGNNILIEKIAKDKVKSNP<br>TTNTPSGYLNFIHREAPNTYECLLQDENFVSLNQRVVSALKATLATLVRVPKALVYAKKDYHLFSEIINDIDE<br>LSYEKAFSYFPVSQTEFENSSNRTIKPLLLFKISNKDLSFAENFEKGNRQKIGKKNLHTLYFEALMKGNQDTIDI<br>GTGMVFHRVKSLNYNEKTLKYGHHSTQLNEKFSYPIIKDKRFASDKFLFHLSTEINYKEKRKPLNNSIIEFLTN<br>NPDINIIGLDRGERHLIYLTLINQKGEILRQKTFNIVGNTNYHEKLNQREKERDNARKSWATIGKIKELKEGFLS<br>LVIHEIAKIMVENNAIVVLEDLNFGFKRGRFKVEKQIYQKFEKMLIDKLNYLVFKDKKANEAGGVLKGYQLA<br>EKFESFQKMGKQSGFLFYVPAAYTSKIDPTTGFVNMLNLNYTNMKDAQTLLSGMDKISFNADANYEFELD<br>YEKFKTNQTDHTNKWTICTVGEKRFTYNSATKETTTVNVTEDLKKLLDKFEVKYSNGDNIKDEICRQTDAKF<br>FEIILWLLKLTMQMRNSNTKTEEDFILSPVKNSNGEFFRSNDDANGIWPADADANGAYHIALKGLYLVKECF<br>NKNEKSLKIEHKNWFKFAQTRFNGSLTKNG* |
| SEQ ID NO: 11 | MENFKNLYPINKTLRFELRPYGKTLENFKKSGLLEKDAFKANSRRSMQAIIDEKFKETIEERLKYTEFSECDLG<br>NMTSKDKKITDKAATNLKQVILSFDDEIFNNYLKPDKNIDALFKNPSNPVISTFKGFTTYFVNFFEIRKHIFK<br>GESSGSMAYRIIDENLTTYLNNIEKIKKLPEELKSQLEGIDQIDKLNNYNEFITQSGITHYNEIIGGISKSENVKIQ<br>GINEGINLYCQKNKVKLPRLTPLYKMILSDRVSNSFVLDTIENDTELIEMISDLINKTEISQDVIMSDIQNIFIKY<br>KQLGNLPGISYSSIVNAICSDYDNNFGDGKRKKSYENDRKKHLETNVYSINYISELLTDTDVSSNIKMRYKEL<br>EQNYQVCKENFNATNWMNIKNIKQSEKTNLIKDLLDILKSIQYPDLFDIVDEDKNPSAEFYTWLSKNAEKLD<br>FEFNSVYNKSRNYLTRKQYSDKKIKLNFDSPTLAKGWDANKEIDNSTIIMRKFNNDRGDYDYFLGIWNKSTP<br>ANEKIIPLEDNGLFEKMQYKLYPDPSKMLPKQFLSKIWKAKHPTTPEFDKKYKEGRHKKGPDFEKEFLHELID<br>CFKHGLVNHDEKYQDVFGFNLRNTEDYNSYTEFLEDVERCNYNLSFNKIADTSNLINDGKLYVFQIWSKDFSI<br>DSKGTKNLNTIYFESLFSEENMIEKMFKLSGEAEIFYRPASLNYCEDILRKHHHAELKDKFDYPIIKDKRYSQ<br>DKFFFHVPMVINYKSEKLNSKSLNNRTNENLGQFTHIIGIDRGERHLIYLTVVDVSTGEIVEQKHLDEIINTDTK<br>GVEHKTHYLNKLEEKSKTRDNERKSWEAIETIKELKEGYISHVINEIQKLQEKYNALIVMENLNYGFKNSRIK<br>VEKQVYQKFETALIKKFNYIIDKKDPETYIHGYQLTNPITTLDKIGNQSGIVLYIPAWNTSKIDPVTGFVNLLYA<br>DDLKYKNQEQAKSFIQKIDNIYFENGEFKFDIDFSKWNNRYSISKTKWTLTSYGTRIQTFRNPQKNNKWDSAE<br>YDLTEEFKLILNIDGTLKSQDVETYKKFMSLFKLMLQLRNSVTGTDIDYMISPVTDKTGTHFDSRENIKNLPA<br>DADANGAYNIARKGIMAIENIMNGISDPLKISNEDYLKYIQNQQE |
| SEQ ID NO: 12 | MTQFEGFTNLYQVSKTLRFELIPQGKTLKHIQEQGFIEEDKARNDHYKELKPIIDRIYKTYADQCLQLVQLDW<br>ENLSAAIDSYRKEKTEETRNALIEEQATYRNAIHDYFIGRTDNLTDAINKRHAEIYKGLFKAELFNGKVLKQL<br>GTVTTTEHENALLRSFDKFTTYFSGFYENRKNVFSAEDISTAIPHRIVQDNFPKFKENCHIFTRLITAVPSLREH<br>FENVKKAIGIFVSTSIEEVFSFPFYNQLLTQTQIDLYNQLLGGISREAGTEKIKGLNEVLNLAIQKNDETAHIIAS<br>LPHRFIPLFKQILSDRNTLSFILEEFKSDEEVIQSFCKYKTLLRNENVLETAEALFNELSNIDLTHIFISHKKLETIS<br>SALCDHWDTLRNALYERRISELTGKITSKAKEKVQRSLKHEDINLQEIISAAGKELSEAFKQKTSEILSHAHAA<br>LDQPLPTTLKKQEEKEILKSQLDSLLGLYHLLDWFAVDESNEVDPEFSARLTGIKLEMEPSLSFYNKARNYAT<br>KKPYSVEKFKLNFQMPTLASGWDVNKEKNNGAILFVKNGLYYLGIMPKQKGRYKALSFEPTEKTSEGFDKM<br>YDYFPDAAKMIPKCSTQLKAVTAHFQTHTTPILLSNNFIEPLEITKEIYDLNNPEKEPKKFQTAYAKKTGDQK<br>GYREALCKWIDFTRDFLSKYYTKTTSIDLSSLRPSSQYKDLGEYYAELNPLLYHISFQRIAEKEIMDAVETGKLY<br>LFQIYNKDFAKGHHGKPNLHTLYWTGLFSPENLAKTSIKLNGQAELFYRPKSRMKRMAHRLGEKMLNKKLK<br>DQKTPIPDTLYQELYDYVNHRLSHDLSDEARALLPNVITKEVSHEIIKDRRFTSDKFFFHVPITLNYQAANSPS<br>KFNQRVNAYLKEHPETPIIGIDRGERNLIYITVIDSTGKILEQRSLNTIQQFDYQKKLDNREKERVAARQAWSV<br>VGTIKDLKQGYLSQVIHEIVDLMIHYQAVVVLENLNFGFKSKRTGIAEKAVYQQFEKMLIDKLNCLVLKDYP<br>AEKVGGVLNPYQLTDQFTSFAKMGTQSGFLFYVPAPYTSKIDPLTGFVDPFVWKTIKNHESRKHFLEGFDFL |

TABLE 5-continued

| SEQ ID NO | Sequence |
|---|---|
| | HYDVKTGDFILHFKMNRNLSFQRGLPGFMPAWDIVFEKNETQFDAKGTPFIAGKRIVPVIENHRFTGRYRDLY PANELIALLEEKGIVFRDGSNILPKLLENDDSHAIDTMVALIRSVLQMRNSNAATGEDYINSPVRDLNGVCFDS RFQNPEWPMDADANGAYHIALKGQLLLNHLKESKDLKLQNGISNQDWLAYIQELRN* |
| SEQ ID NO: 13 | MAVKSIKVKLRLDDMPEIRAGLWKLHKEVNAGVRYYTEWLSLLRQENLYRRSPNGDGEQECDKTAEECKA ELLERLRARQVENGHRGPAGSDDELLQLARQLYELLVPQAIGAKGDAQQIARKFLSPLADKDAVGGLGIAKA GNKPRWVRMREAGEPGWEEEKEKAETRKSADRTADVLRALADFGLKPLMRVYTDSEMSSVEWKPLRKGQ AVRTWDRDMFQQAIERMMSWESWNQRVGQEYAKLVEQKNRFEQKNFVGQEHLVHLVNQLQQDMKEASP GLESKEQTAHYVTGRALRGSDKVFEKWGKLAPDAPFDLYDAEIKNVQRRNTRRFGSHDLFAKLAEPEYQAL WREDASFLTRYAVYNSILRKLNHAKMFATFTLPDATAHPIWTRFDKLGGNLHQYTFLFNEFGERRHAIRFHK LLKVENGVAREVDDVTVPISMSEQLDNLLPRDPNEPIALYFRDYGAEQHFTGEFGGAKIQCRRDQLAHMHRR RGARDVYLNVSVRVQSQSEARGERRPPYAAVFRLVGDNHRAFVHFDKLSDYLAEHPDDGKLGSEGLLSGLR VMSVDLGLRTSASISVFRVARKDELKPNSKGRVPFFFPIKGNDNLVAVHERSQLLKLPGETESKDLRAIREER QRTLRQLRTQLAYLRLLVRCGSEDVGRRERSWAKLIEQPVDAANHMTPDWREAFENELQKLKSLHGICSDK EWMDAVYESVRRVRHMGKQVRDWRKDVRSGERPKIRGYAKDVVGGNSIEQIEYLERQYKFLKSWSFFG KVSGQVIRAEKGSRFAITLREHIDHAKEDRLKKLADRIIMEALGYVYALDERGKGKWVAKYPPCQLILLEELS EYQFNNDRPPSENNQLMQWSHRGVFQELINQAQVHDLLVGTMYAAFSSRFDARTGAPGIRCRRVPARCTQE HNPEPFPWWLNKFVVEHTLDACPLRADDLIPTGEGEIFVSPFSAEEGDFHQIHADLNAAQNLQQRLWSDFDIS QIRLRCDWGEVDGELVLIPRLTGKRTADSYSNKVFYTNTGVTYYERERGKKRRKVFAQEKLSEEEAELLVEA DEAREKSVVLMRDPSGIINRGNWTRQKEFWSMVNQRIEGYLVKQIRSRVPLQDSACENTGDI* |
| SEQ ID NO: 14 | MATRSFILKIEPNEEVKKGLWKTHEVLNHGIAYYMNILKLIRQEAIYEHHEQDPKNPKKVSKAEIQAELWDFV LKMQKCNSFTHEVDKDVVFNILRELYEELVPSSVEKKGEANQLSNKFLYPLVDPNSQSGKGTASSGRKPRWY NLKIAGDPSWEEEKKKWEEDKKKDPLAKILGKLAEYGLIPLFIPFTDSNEPIVKEIKWMEKSRNQSVRRLDKD MFIQALERFLSWESWNLKVKEEYEKVKEHKTLEERIKEDIQAEPKSLEQYEKERQEQLLRDTLNTNEYRLSK RGLRGWREIIQKWLKMDENEPSEKYLEVFKDYQRKHPREAGDYSVYEFLSKKENHFIWRNHPEYPYLYATF CEIDKKKKDAKQQATFTLADPINHPLWVRFEERSGSNLNKYRILTEQLHTEKLKKKLTVQLDRLIYPTESGG WEEKGKVDIVLLPSRQFYNQIFLDIEEKGKHAFTYKDESIKFPLKGTLGGARVQFDRDHLRRYPHKVESGNV GRIYFNMTVNIEPTESPVSKSLKIHRDDFPKFVNFKPKELTEWIKTINKIDSKGKKLKSGIESLEIGLRVMSIDLGQRQA AAASIFEVVDQKPDIEGKLFFPIKGTELYAVHRASFNIKLPGETLVKSREVLRKAREDNLKLMNQKLNFLRNV LHFQQFEDITEREKRVTKWISRQENSDVPLVYQDELIQIRELMYKPYKDWVAFLKQLHKRLEVEIGKEVKHW RKSLSDGRKGLYGISLKNIDEIDRTRKFLLRWSLRPTEPGEVRRLEPGQRFAIDQLNHLNALKEDRLKKMANT IIMHALGYCYDVRKKKWQAKNPACQIILFEDLSNYNPYEERSRFENSKLMKWSRREIPRQVALQGEIYGLQV GEVGAQFSSRFHAKTGSPGIRCSVVTKEKLQDNRFFKNLQREGRLTLDKIAVLKEGDLYPDKGGEKFISLSKD RKLVTTHADINAAQNLQKRFWTRTHGFYKVYCKAYQVDGQTVYIPESKDQKQKIIEEFGEGYFILKDGVYE WGNAGKLKIKKGSSKQSSSELVDSDILKDSFDLASELKGEKLMLYRDPSGNVFPSDKWMAAGVFFGKLERIL ISKLTNQYSISTIEDDSSKQSM* |
| SEQ ID NO: 15 | MPTRTINLKLVLGKNPENATLRRALFSTHRLVNQATKRIEEFLLLCRGEAYRTVDNEGKEAEIPRHAVQEEAL AFAKAAQRHNGCISTYEDQEILDVLRQLYERLVPSVNENNEAGDAQAANAWVSPLMSAESEGGLSVYDKVL DPPPVVWMKLKEEKAPGWEAASQIWIQSDEGQSLLNKPGSPPRWIRKLRSGQPWQDDFVSDQKKKQDELTKG NAPLIKQLKEMGLLPLVNPFFRHLLDPEGKGVSPWDRLAVRAAVAHFISWESWNHRTRAEYNSLKLRRDEFE AASDEFKDDFTLLRQYEAKRHSTLKSIALADDSNPYRIGVRSLRAWNRVREEWIDKGATEEQRVTILSKLQT QLRGKFGDPDLFNWLAQDRHVHLWSPRDSVTPLVRINAVDKVLRRRKPYALMTFAHPRFHPRWILYEAPGG SNLRQYALDCTENALHITLPLLVDDAHGTWIEKKIRVPLAPSGQIQDLTLEKLEKKKNRLYYRSGFQQFAGLA GGAEVLFHRPYMEHDERSEESLLERPGAVWFKLTLDVATQAPPNWLDGKGRVRTPPEVHHFKTALSNKSKH TRTLQPGLRVLSVDLGMRTFASCSVFELIEGKPETGRAFPVADERSMDSPNKLWAKHERSFKLTLPGETPSRK EEEERSIARAEIYALKRDIQRLKSLLRLGEEDNDNRRDALLEQFFKGWGEEDVVPGQAFPRSLFQGLGAAPFR STPELWRQHCQTYYDKAEACLAKHISDWRKRTRPRPTSREMWYKTRSYHGGKSIWMLEYLDAVRKLLLSW SLRGRTYGAINRQDTARFGSLASRLLHHINSLKEDRIKTGADSIVQAARGYIPLPHGKGWEQRYEPCQLILFED LARYRFRVDRPRRENSQLMQWNHRAIVAETTMQAELYGQIVENTAAGFSSRFHAATGAPGVRCRFLLERDF DNDLPKPYLLRELSWMLGNTKVESEEEKLRLLSEKIRPGSLVPWDGGEQFATLHPKRQTLCVIHADMNAAQ NLQRRFFGRCGEAFRLVCQPHGDDVLRLASTPGARLLGALQQLENGQGAFELVRDMGSTSQMNRFVMKSL GKKKIKPLQDNNGDDELEDVLSVLPEEDDTGRITVFRDSSGIFFPCNVWIPAKQFWPAVRAMIWKVMASHSL G* |
| SEQ ID NO: 16 | MTKLRHRQKKLTHDWAGSKKREVLGSNGKLQNPLLMPVKKGQVTEFRKAFSAYARATKGEMTDGRKNMF THSFEPFKTKPSLHQCELADKAYQSLHSYLPGSLAHFLLSAHALGFRIFSKSGEATAFQASSKIEAYESKLASE LACVDLSIQNLTISTLFNALTTSVRGKGEETSADPLIARFYTLLTGKPLSRDTQGPERDLAEVISRKIASSFGTW KEMTANPLQSLQFFEEELHALDANVSLSPAFDVLIKMNDLQGDLKNRTIVFDPDAPVFEYNAEDPADIIIKLTA RYAKEAVIKNQNVGNYVKNAITTTNANGLGWLLNKGLSLLPVSTDDELLEFIGVERSHPSCHALIELIAQLEA PELFEKNVFSDTRSEVQGMIDSAVSNHIARLSSSRNSLSMDSEELERLIKSFQIHTPHCSLFIGAQSLSQQLESLP EALQSGVNSADILLGSTQYMLTNSLVEESIATYQRTLNRINYLSGVAQOINGAIKRKAIDGEKIHLPAAWSELI SLPFIGQPVIDVESDLAHLKNQYQTLSNEFDTLISALQKNFDLNFNKALLNRTQHFEAMCRSTKKNALSKPEIV SYRDLLARLTSCLYRGSLVLRRAGIEVLKKHKIFESNSELREHVHERKHFVFVSPLDRKAKKLLRLTDSRPDL LHVIDEILQHDNLENKDRESLWLVRSGYLLAGLPDQLSSSFINLPIITQKGDRRLIDLIQYDQINRDAFVMLVTS AFKSNLSGLQYRANKQSFVVTRTLSPYLGSKLVYVPKDKDWLVPSQMFEGRFADILQSDYMVWKDAGRLC VIDTAKHLSNIKKSVFSSEEVLAFLRELPHRTFIQTEVRGLVNVGLAFNNGDIPSLKTFSNCVQVKVSRTNT SLVQTLNRWFEGGKVSPPSIQFERAYYKKDDQIHEDAAKRKIRFQMPATELVHASDDAGWTPSYLLGIDPGE YGMGLSLVSINNGEVLDSGFIHINSLINFASKKSNHQTKVVPRQQYKSPYANYLEQSKDSAAGDIAHILDRLIY KLNALPVFEALSGNSQSAADQWTKVLSFYTWGDNDAQNSIRKQHWFGASHWDIKGMLRQPPTEKKPKPYI AFPGSQVSSYGNSQRCSCCGRNPIEQLREMAKDTSIKELKIRNSEIQLFDGTIKLFNPDPSTVIERRRHNLGPSRI PVADRTFKNISPSSLEFKELITIVSRSIRHSPEFIAKKRGIGSEYFCAYSDCNSSLNSEANAAANVAQKFQKQLFF EL* |

TABLE 5-continued

| SEQ ID NO | Sequence |
|---|---|
| SEQ ID NO: 17 | MKRILNSLKVAALRLLFRGKGSELVKTVKYPLVSPVQGAVEELAEAIRHDNLHLFGQKEIVDLMEKDEGTQV YSVVDFWLDTLRLGMFFSPSANALKITLGKFNSDQVSPFRKVLEQSPFFLAGRLKVEPAERILSVEIRKIGKRE NRVENYAADVETCFIGQLSSDEKQSIQKLANDIWDSKDHEEQRMLKADFFAIPLIKDPKAVTEEDPENETAGK QKPLELCVCLVPELYTRGFGSIADFLVQRLTLLRDKMSTDTAEDCLEYVGIEEEKGNGMNSLLGTFLKNLQG DGFEQIFQFMLGSYVGWQGKEDVLRERLDLLAEKVKRLPKPKFAGEWSGHRMFLHGQLKSWSSNFFRLFNE TRELLESIKSDIQHATMLISYVEEKGGYHPQLLSQYRKLMEQLPALRTKVLDPEIEMTHMSEAVRSYIMIHKS VAGFLPDLLESLDRDKDREFLLSIFPRIPKIDKKTKEIVAWELPGEPEEGYLFTANNLFRNFLENPKHVPRFMA ERIPEDWTRLRSAPVWFDGMVKQWQKVVNQLVESPGALYQFNESFLRQRLQAMLTVYKRDLQTEKFLKLL ADVCRPLVDFFGLGGNDIIFKSCQDPRKQWQTVIPLSVPADVYTACEGLAIRLRETLGFEWKNLKGHEREDFL RLHQLLGNLLFWIRDAKLVVKLEDWMNNPCVQEYVEARKAIDLPLEIFGFEVPIFLNGYLFSELRQLELLLRR KSVMTSYSVKTTGSPNRLFQLVYLPLNPSDPEKKNSNNFQERLDTPTGLSRRFLDLTLDAFAGKLLTDPVTQE LKTMAGFYDHLFGFKLPCKLAAMSNHPGSSSKMVVLAKPKKGVASNIGFEPIPDPAHPVFRVRSSWPELKYL EGLLYLPEDTPLTIELAETSVSCQSVSSVAFDLKNLTTILGRVGEFRVTADQPFKLTPIIPEKEESFIGKTYLGLD AGERSGVGFAIVTVDGDGYEVQRLGVHEDTQLMALQQVASKSLKEPVFQPLRKGTFRQQERIRKSLRGCYW NFYHALMIKYRAKVVHEESVGSSGLVGQWLRAFQKDLKKADVLPKKGGKNGVDKKKRESSAQDTLWGGA FSKKEEQQIAFEVQAAGSSQFCLKCGWWFQLGMREVNRVQEGSGVVLDWNRSIVTFLIESSGEKVYGFSPQQL EKGFRPDIETFKKMVRDFMRPPMFDRKGRPAAAYERFVLGRRHRRYRFDKVFEERFGRSALFICPRVGCGNF DHSSEQSAVVLALIGYIADKEGMSGKKLVYVRLAELMAEWKLKKLERSRVEEQSSAQ* |
| SEQ ID NO: 18 | MAESKQMQCRKCGASMKYEVIGLGKKSCRYMCPDCGNHTSARKIQNKKKRDKKYGSASKAQSQRIAVAG ALYPDKKVQTIKTYKYPADLNGEVHDSGVAEKIAQAIQEDEIGLLGPSSEYACWIASQKQSEPYSVVDFWFD AVCAGGVFAYSGARLLSTVLQLSGEESVLRAALASSPFVDDINLAQAEKPFLAVSRRTGQDKLGKRIGECFAE GRLEALGIKDRMREFVQAIDVAQTAGQRFAAKLKIFGISQMPEAKQWNNDSGLTVCILPDYYVPEENRADQL VVLLRRLREIAYCMGIEDEAGFEHLGIDPGALSNFSNGNPKRGFLGRLLNNDIIALANNMSAMTPYWEGRKG ELIERLAWLKHRAEGLYLKEPHFGNSWADHRSRIFSRIAGWLSGCAGKLKIAKDQISGVRTDLFLLKRLLDAV PQSAPSPDFIASISALDRFLEAAESSQDPAEQVRALYAFHLNAPAVRSIANKAVQRSDSQEWLIKELDAVDHL EFNKAFPFFSDTGKKKKKGANSNGAPSEEEYTETESIQQPEDAEQEVNGQEGNGASKNQKKFQRIPRFFGEGS RSEYRILTEAPQYFDMFCNNMRAIFMQLESQPRKAPRDFKCFLQNRLQKLKYQTFLNARSNKCRALLESVLIS WGEFYTYGANEKKFRLRHEASERSSDPDYVVQQALEIARRLFLFGFEWRDCSAGERVDLVEIHKKAISFLLAI TQAEVSVGSYNWLGNSTVSRYLSVAGTDTLYGTQLEEFLNATVLSQMRGLAIRLSSQELKDGFDVQLESSCQ DNLQHLLVYRASRDLAACKRATCPAELDPKILVLPVGAFIASVMKMIERGDEPLAGAYLRHRPHSFGWQIRV RGVAEVGMDQGTALAFQKPTESEPPFKIKPFSAQYGPVLWLNSSSYSQSQYLDGFLSQPKNWSMRVLPQAGS VRVEQRVALIWNLQAGKMRLERSGARAFFMPVPFSFRPSGSGDEAVLAPNRYLGLFPHSGGIEYAVVDVLDS AGFKILERGTIAVNGFSQKRGERQEEAHREKQRRGISDIGRKKPVQAEVDAANELHRKYTDVATRLGCRIVV QWAPQPKPGTAPTAQTVYARAVRTEAPRSGNQEDHARMKSSWGYTWGTYWEKRKPEDILGISTQVYWTG GIGESCPAVAVALLGHIRATSTQTEWEKEEVVFGRLKKFFPS* |
| SEQ ID NO: 19 | MEKRINKIRKKLSADNATKPVSRSGPMKTLLVRVMTDDLKKRLEKRRKKPEVMPQVISNNAANNLRMLLDD YTKMKEAILQVYWQEFKDDHVGLMCKFAQPASKKIDQNKLKPEMDEKGNLTTAGFACSQCGQPLFVYKLE QVSEKGKAYTNYFGRCNVAEHEKLILLAQLKPEKDSDEAVTYSLGKFGQRALDFYSIHVTKESTHPVKPLAQ IAGNRYASGPVGKALSDACMGTIASFLSKYQDIIIEHQKVVKGQKRLESLRELAGKENLEYPSVTLPPQPHT KEGVDAYNEVIARVRMWVNLNLWQKLKLSRDDAKPLLRLKGFPSFPVVERRENEVDWWNTINEVKKLIDA KRDMGRVFWSGVTAEKRNTILEGYNYLPNENDHKKREGSLENPKKPAKRQFGDLLLYLEKKYAGDWGKVF DEAWERIDKKIAGLTSHIEREEARNAEDAQSKAVLTDWLRAKASFVLERLKEMDEKEFYACEIQLQKWYGD LRGNPFAVEAENRVVDISGFSIGSDGHSIQYRNLLAWKYLENGNPKREFYLLMNYGKKGRIRFTDGTDIKKSGK WQGLLYGGGKAKVIDLTFDPDDEQLIILPLAFGTRQGREFIWNDLLSLETGLIKLANGRVIEKTIYNKKIGRDE PALFVALTFERREVVDPSNIKPVNLIGVDRGENIPAVIALTDPEGCPLPEFKDSSGGPTDILRIGEGYKEKQRAI QAAKEVEQRRAGGYSRKFASKSRNLADDMVRNSARDLFYHAVTHDAVLVFENLSRGFGRQGKRTFMTERQ YTKMEDWLTAKLAYEGLTSKTYLSKTLAQYTSKTCSNCGFTITMEDWLTAKLVRLKKTSDGWATTLNNKEL KAEGQITYYNRYKRQTVEKELSAELDRLSEESGNNDISKWTKGRRDEALFLLKKRYSHRPVQEQFVCLDCGH EVHADEQAALNIARSWLFLNSNSTEFKSYKSGKQPFVGAWQAFYKRRLKEVWKPNA |
| SEQ ID NO: 20 | MKRINKIRRRLVKDSNTKKAGKTGPMKTLLVRVMTPDLRERLENLRKKPENIPQPISNTSRANLNKLLTDYTE MKKAILHVYWEEFQKDPVGLMSRVAQPAPKNIDQRKLIPVKDGNERLTSSGFACSQCCQPLYVYKLEQVND KGKPHTNYFGRCNVSEHERLILLSPHKPEANDELVTYSLGKFGQRALDFYSIHVTRESNHPVKPLEQIGGNSC ASGPVGKALSDACMGAVASFLTKYQDIILEHQKVIKKNEKRLANLKDIASANGLAFPKITLPPQPHTKEGIEA YNNVVAQIVIWVNLNLWQKLKIGRDEAKPLQRLKGFPSFPLVERQANEVDWWDMVCNVKKLINEKKEDGK VFWQNLAGYKRQEALLPYLSSEEDRKKGKKFARYQFGDLLLHLEKKHGEDWGKVYDEAWERIDKKVEGLS KHIKLEEERRSEDAQSKAALTDWLRAKASFVIEGLKEADKDEFCRCELKLQKWYGDLRGKPFAIEAENSILDI SGFSKQYNCAFIWQKDGVKKLNLYLIINYFKGGKLRFKKIKPEAFEANRFYTVINKKSGEIVPMEVNFNFDDP NLIILPLAFGKRQGREFIWNDLLSLETGSLKLANGRVIEKTLYNRRTRQDEPALFVALTFERREVLDSSNIKPM NLIGIDRGENIPAVIALTDPEGCPLSRFKDSLGNPTHILREGSKEKQRTIQAAKEVEQRRAGGYSRKYASKA KNLADDMVRNTARDLLYYAVTQDAMLIFENLSRGFGRQGKRTFMAERQYTRMEDWLTAKLAYEGLPSKT YLSKTLAQYTSKTCSNCGFTITSADYDRVLEKLKKTATGWMTTINGKELKVEGQITYYNRYKRQNVVKDLS VELDRLSEESVNNDISSWTKGRSGEALSLLKKRFSHRPVQEKFVCLNCGFETHADEQAALNIARSWLFLRSQE YKKYQTNKTTGNTDKRAFVETWQSFYRKKLKEVWKP |
| SEQ ID NO: 21 | atgGGAAAAATGTATTATCTTGGTCTGGATATAGGAACAAATTCTGTTGGATATGCCGTAACCGACCCATC GTACCATTTGCTCAAATTTAAAGGCGAACCGATGTGGGGTGCCCACGTGTTTGCTGCGGGGAATCAATC AGCTGAACGGAGAAGCTTTCGTACGAGCCGCAGACGCCTTGACCGGAGCGGCAACAGCGTGTCAAACTGGT TCAAGAAATCTTTGCTCCCGTGATTAGTCCCATTGATCCACGTTTTTTTATCAGACTTCATGAGAGCGCTT TATGGCGGGATGATGTGGCTGAAACGGATAAACATATTTTCTTTAATGACCCGACCTATACGGATAAGG AATATTATTCTGACTATCCAACCATCCATCATCTCATTGTGGACCTTATGGAAAGCAGTGAAAAGCATGA CCCGCGGCTTGTTTATTTGGCTGTTGCCTGGCTGGTTGCTCATCGTGGTCATTTCCTCAATGAAGTGGATA AGGATAATATTGGGGATGTCCTGAGTTTTGACGCCTTTTATCCTGAGTTTCTGGCATTTCTTTCCGATAAT |

TABLE 5-continued

| SEQ ID NO | Sequence |
|---|---|
| | GGGGTGTCACCTTGGGTATGTGAGTCAAAAGCACTCCAAGCGACCCTGCTTTCACGAAACTCCGTCAAC<br>GATAAGTATAAAGCCTTGAAGTCTCTGATCTTTGGCAGCCAAAAGCCGGAGGATAATTTTGATGCCAAT<br>ATCAGTGAAGATGGACTTATCCAACTTTTAGCAGGAAAAAAGGTCAAGGTCAATAAACTTTTTCCTCAA<br>GAAAGTAATGATGCTTCCTTTACACTCAATGATAAGGAAGATGCAATTGAGGAAATCTTAGGAACGCTT<br>ACACCGGATGAGTGTGAATGGATTGCGCATATTAGGAGGCTGTTTGATTGGGCCATCATGAAACATGCT<br>CTCAAAGATGGCAGAACAATCTCCGAATCGAAAGTAAAGCTCTATGAACAGCATCACCATGACTTGACA<br>CAGCTCAAGTATTTTGTGAAGACCTATCTAGCAAAGGAATATGATGACATTTTTCGAAACGTAGATAGT<br>GAAACAACCAAAAACTATGTCGCATATTCCTATCATGTAAAAGAAGTCAAGGGTACATTGCCCAAAAAT<br>AAGGCAACCCAAGAAGAATTTTGCAAGTATGTCCTTGGAAAGGTAAAGAACATCGAATGCAGTGAAGC<br>TGATAAGGTTGATTTTGATGAAATGATTCAGCGTCTTACAGACAATTCCTTTATGCCGAAACAAGTATCA<br>GGTGAAAACAGGGTTATCCCTTACCAGCTTTACTATTATGAACTAAAGACTATTTTGAATAAAGCCGCTT<br>CTTATCTGCCTTTTTTGACCCAATGCGGAAAAGATGCCATCTCCAATCAAGATAAGCTCCTTTCCATCAT<br>GACCTTTCGGATTCCGTATTTCGTTGGGCCCTTGCGCAAGGACAATTCAGAGCATGCCTGCCTGGAACGA<br>AAAGCAGGGAAAATCTATCCGTGGAATTTTAACGACAAAGTTGACCTTGATAAAAGTGAAGAAGCGTTC<br>ATTCGGAGAATGACGAATACCTGCACTTATTATCCCGGTGAAGATGTTTTGCCACTTGACTCCCTTATTT<br>ATGAAAAATTCATGATCCTCAATGAAATCAATAATATCCGAATTGATGGTTATCCTATTTCTGTAGATGT<br>AAAACAGCAGGTTTTTGGCCTCTTTGAAAAGAAGAAGAAGTGACCGTAAAGGATATCCAGAATCTCCT<br>GCTTTCCTTGGGTGCCTTGGATAAGCATGGTAAATTGACGGGAATCGATACTACCATCCATAGCAATTAC<br>AATACATACCATCATTTTAAATCGCTCATGGAGCGTGGCGTTCTTACTCGTGATGATGTGGAACGCATTG<br>TGGAGCGTATGACCTATAGTGATGATACAAAACGCGTCCGTCTTTGGCTGAACAATAATTATGGAACGC<br>TCACTGCTGACGACGTAAAGCATATTTCAAGGCTCCGAAAGCATGATTTTGGCCGGCTTTCCAAAATGTT<br>CCTCACAGGCCTAAAGGGAGTTCATAAGGAAACGGGGGAACGAGCTTCCATTTTGGATTTTATGTGGAA<br>TACCAATGATAACTTGATGCAGCTTTTATCTGAATGTTATACTTTTTCGGATGAAATTACCAAGCTGCAG<br>GAAGCATACTATGCCAAGGCGCAGCTTTCCCTGAATGATTTTCTGGACTCCATGTATATTTCAAATGCTG<br>TCAAACGTCCTATCTATCGAACTCTTGCCGTTGTAAATGACATACGCAAAGCCTGTGGGACGGCGCCAA<br>AACGCATTTTTATCGAAATGGCAAGAGATGGGGAAAGCAAAAAGAAAAGGAGCGTAACAAGAAGAGA<br>ACAAATCAAGAATCTTTATAGGTCCATCCGCAAGGATTTTCAGCAGGAGGTAGATTTCCTTGAAAAAAT<br>CCTTGAAAACAAAAGCGATGGACAGCTGCAAAGCGATGCGCTCTATCTATACTTTGCGCAGCTTGGAAG<br>GGATATGTATACCGGGGACCCTATCAAGTTGGAGCATATCAAGGACCAGTCCTTCTTCTATAATATTGATCAT<br>ATCTATCCCCAAAGCATGGTCAAGGACGATAGTCTTGATAACAAGGTGTTGGTTCAATCGGAAATTAAT<br>GGAGAGAAGAGCAGTCGATATCCTCTTGATGCTGCTATCCGTAATAAAATGAAGCCTCTTTGGGATGCTT<br>ATTATAACCATGGCCTGATTTCCCTCAAGAAGTATCAGCGTTTGACGCGGAGCACTCCCTTTACAGATGA<br>TGAAAAGTGGGATTTCATCAATCGGCAGCTTGTTGAGACAAGACAATCCACGAAGGCCTTGGCAATCTT<br>ACTAAAAAGGAAGTTCCCTGATACGGAGATTGTCTACTTCCAAGGCAGGGCTTTCTTCTGATTTTCGACAT<br>GAGTTTGGTCTCGTAAAATCGAGGAATATCAATGACCTGCACCATGCAAAGGACGCATTTCTTGCGATT<br>GTAACAGGAAATGTCTATCATGAACGCTTTAATCGCCGGTGGTTTATGGTGAACCAGCCCTATTCCGTCA<br>AGACCAAGACGTTGTTTACGCATTCTATTAAAAATGGTAATTTTGTAGCTTGGAATGGAGAAGAGGATC<br>TTGGCCGCATTGTTAAAATGTTAAAGCAAAATAAGAACACTATTCATTTCACGCGGTTCTCTTTTGATCG<br>AAAGGAAGGCCTGTTTGATATTCAGCCACTAAAAGCGTCAACCGGTCTTGTACCAAGAAAAGCCGGACT<br>AGACGTGGTAAAATATGGTGGCTATGACAAATCGACAGCAGCTTATTATCTCCTTGTTCGATTTACACTA<br>GAAGATAAAAGACTCAACATAAATTGATGATGATTCCTGTAGAAGGCTTGTATAAAGCTCGAATTGAC<br>CATGATAAGGAATTCTTAACGGACTATGCACAAACTACAATCAGTGAAATCCTACAAAAAGATAAACAA<br>AAGGTGATAAATATAATGTTTCCAATGGGAACAAGGCACATTAAACTGAATTCCATGATTTCAATCGAT<br>GGTTTTTATCTTTCCATTGGAGGAAAGTCTAGTAAGGGAAAATCGGTGTTGTGTCATGCTATGGTACCTC<br>TTATTGTACCTCATAAGATAGAATGTTATATTAAGGCGATGGAGTCTTTTGCACGTAAATTTAAAGAAAA<br>TAATAAATTAAGGATTGTGGAAAAGTTTGATAAGATTACGGTGGAGATAACTTGAACCTATACGAACT<br>ATTTTTACAAAAACTTCAACATAACCCATATAATAAGTTCTTCTCCACACAATTTGATGTGCTGACTAAT<br>GGAAGAAGTACATTTACTAAATTATCTCCAGAGGAACAAGTTCAAACGTTATTGAATATCTTATCAATTT<br>TTAAAACTTGTCGGAGCTCTGGCTGCGATTTAAAATCCATTAACGGTTCTGCTCAAGCTGCCAGAATTAT<br>GATCAGCGCAGATTTAACTGGACTCTCAAAAAAATATTCCGATATTCGGCTTGTTGAGCAATCAGCATCT<br>GGACTTTTTGTTAGTAAATCACAAAATCTTTTGGAGTATTTAtga |
| SEQ ID NO: 22 | atgtcttcattaacaaaatttacaaataaatacagtaagcagctaaccataaaaaatgaactcatcccagtaggaaagactctcgagaacattaaggaa<br>aacggtctcatagatgggagatgaacagctaaacgagaattatcaaaaagcaaagataatcgttgatgatttctacgagatttcataaataaagctttta<br>aataataccaaataggaaattggagagaattagcagatgcttttaaataaagaagatgaagataacatagaaaagctccaagacaaaatcagaggaata<br>attgtaagtaaattcgagacatttgatttgttttcttcttactcgataaagaaagacgaaaagataatagatgatgataatgatgttgaagaagaggag<br>ctagatctaggaaaaaaaacttcctcatttaaatatattttaagaaaaacctttttaaattagtacttccttcttatttaaagacaacaaatcaggat<br>aaactgaaaataatctcttcttttgataattttttctacctatttcagaggattctttgagaacagaaaaaatatttcactaagaagcctatatctacg<br>tcaattgcctacagaattgtccatgataactttccaaagtttctagataacatcagatgttttaatgtgtggcaaacagaatgccacagttaattgta<br>aaggctgataattatttaaaatcaaagaacgtcatagctaaagataaatctttagcaaactattttactgtaggagcatatgattacttcttatcccag<br>aatggcattgatttctacaacaacattatcggcggtctaccagcatttgctggtcatgagaaaatccaaggacttaatgaatttataaatcaagaatgc<br>caaaaggacagcgaactaaaatctaaactgaaaaacagacatgcttcaaaatggctgttctatttaagcaaattctttcagatagagaaaaaagtttt<br>gttatagacgagttcgaatctgatgctcaggtcatagatgcggttaagaatgccaatgtaaggataataatgttattttaaccttcta<br>aatcttatcaagaatatagcgttcttatctgatgatgaattagatggaattttttatagaaggcaagtatttaagctctgtttcccaaaagctatattca<br>gattggtcgaagcttcgaaatgatattgaagatagtgcaaacagtaaacaaggaaataaagagttagcaaagaaaattaaaacaaataaaggcgatgtt<br>gaaaaggccataagtaaatatgagttttctttatcagaacttaactcaattgtacatgataatacaaaattcagtgaccttctttcttgtacgttacat<br>aaagtggctagcgaaaaactgattgaaagttaatgaagggggactggccaaaacacctgaaaaataagtgaagataacaaaagataaaagagccttttagat<br>gcattgttagaaatttataatacattgctgatattcaactgcaagtcatttaataagaacggtaatttctatgttgattatgacagatgcataaatgag<br>ctttctagtgttgtttatttatataacaaaacaagaaattactgtacaaagaaacctttataacacagacaaattcaaattaaacttttaacagtcctcaa<br>ttaggagagggctttagtaagtcgaaagaaaatgactgtctgacattatttatttaaaaaagacgacaattactatgttggaattatcagaaaagggca<br>aaaattaactttgatgatacaagccattgcagacaatacaaatcagatgtatattttaagatgaattatttcctattaaaagatgctaaaagttattt<br>cctaaatgttcaattcagttaaaagaagtaaaagcacattttaaaaaaatcagaggatgattatatcctgagtgacaaagaaaatttgcctctcccctt<br>gttattaagaaatcaacatttttattagcaacagcacatgtaaaaggaaagaaaggaaacataaaaaaattccaaaaggaatattctaggaaaatccaa<br>acagaatatagaaattctctgaatgaatggattgcattttgtaaagaatttctaaaaacatataaggcggcaacaatctttgacattacaacgttaaaa<br>aaagctgaagaatatgctgatattgttgagtttataaggatgtagataatcttgttataaactagagttttgccctattaaaacatcttttcattgag<br>aatcttattgataatgggggactttatatttattcagaatcaataataaagatttcagttcaaaatctactggtacaaagaatcttcatacgctctatctt |

TABLE 5-continued

| SEQ ID NO | Sequence |
|---|---|
| | caggcaatctttgatgaaagaaacctcaataatcctactattatgttaaatggcggagcagagttatttttatcgaaaagaaagcattgaacagaaaat aggataactcataaggcaggatcaattcttgtaaacaaggtttgtaaggatggaacaagtctagatgacaaaatcagaaacgaaatatatcaatatgaa aacaagtttattgatacattgtctgatgaagctaaaaaagtttttacctaatgtaataaaaaaagaagcaactcacgacataacaaaagataagcgattt acatcagataagttcttttttccattgcccattaacaattaactataaggaaggagatacaaaacaatttaacaatgaggttttatctttccttagaggt aatccagacattaatatcatcggaattgacagaggagaaagaaaccttatatacgtaactttattaatcagaaaggcgaaatacttgacagcgtttcg tttaacacagtaacaaacaagtcgagcaaaattgaacaaactgttgattatgaggaaaagcttgctgttagggaaaaagaaagaatagaagcaaaaga tcctgggattcaatatcaaagatagcaaccttaaaagaaggttatctatcagctattgttcatgagatatgcctactgatgatcaaacacaacgcaatc gttgtacttgagaatctaaatgcaggatttaagagaattagaggaggattatcagaaaagtctgtttatcagaaattcgagaagatgcttattaacaaa ctaaattactttgtatctaaaaaagaatcagactggaataaacctagtggactttttaaatggtttacaacttcagaccagttcgagtcatttgagaaa ttaggaattcaatctgggttcatcttctatgttcctgcagcatatacatctaagattgatcctacaacaggatttgcaaatgttcttaacttatccaag gtaagaaatgttgatgcaataaagagttttttcagtaatttcaatgaaatttcatatagcaaaaaagaagctctctttaaattctcttttgatttagat tccttatcaaagaagggcttcagctcatttgtaaaattcagtaaatctaaatgaatgtatatacatttggagagagaataataaaaccaaagaataag caagggtatcgtgaagataagagaattaatttaacatttgaatgaaaaaactctgaatgaatatataaagtaagtttgatcttgaaaacaaacttaatt ccaaatctaacctctgcaaatctgaaagataccttctggaaagaactattctttatttttaaaacaactctgcagcttagaaacagtgtaacaaatggc aaagaagatgtactgattctccagtaaagaacgctaaaggagagttctttgtatcaggaactcataacaagacattacctcaagactgtgatgcaaat ggagcatatcatatcgccctaaaaggtctgatgattcttgaacgtaacaatcttgttagagaagaaaaagacacaaagaagataatggcaatttctaat gttgactggtttgagtatgttcaaaaaaggagaggtgtcctgtaa |
| SEQ ID NO: 23 | ATGAACAACTATGATGAGTTTACCAAACTGTACCCAATACAGAAAACGATAAGGTTCGAATTGAAGCCG CAGGGAAGAACGATGGAACACCTCGAAACATTCAACTTTTTCGAAGAGGACAGGGATAGAGCGGAGAA ATATAAGATTTTAAAGGAAGCAATCGACGAGTATCATGAAAGTTTATAGACGAACATCTAACAAATAT GTCTCTTGACTGGAATTCTTTAAAACAGATTTCAGAGAAATACTATAAGAGTAGAGAGGAAAAAGACAA GAAAGTTTTTCTGTCAGAACAGAAACGCATGAGGCAAGAGATAGTTTCTGAGTTCAAAAAGACGATCG GTTTAAAGATCTTTTTTCAAAAAAATTGTTTTCTGAACTTCTCAAGGAAGAGATTTACAAAAAAGGAAAC CATCAGGAAATTGACGCATTGAAAAGTTTTGATAAATTCTCAGGCTATTTTATTGGGTTGCATGAGAACC GAAAAAAATATGTATTCTGACGGAGACGAGATCACGGCTATCTCTAACCGTATTGTAAATGAGAATTTCC CGAAGTTCCTCGACAACCTTCAGAAATATCAGGAAGCTCGTAAAAAATATCCAGAGTGGATCATTAAGG CAGAATCTGCTTTAGTTGCACATAATATCAAGATGGATGAAGTCTTTTCCTTAGAGTATTTCAACAAAGT CCTGAATCAAGAAGGAATACAGAGATACAATCTCGCCCTAGGTGCTATGTGACCAAAAGTGGTGAGA AAATGATGGGCTTAATGATGCACTTAATCTTGCCCATCAAAGTGAAAAAAGCAGCAAGGGAAGGATA CACATGACTCCACTCTTCAAACAGATTCTGAGTGAAAAAGAGTCCTTTTCTTATATACCAGATGTTTTTA CAGAAGACTCTCAACTTTTACCATCCATTGGTGGGTTCTTTGCACAAATAGAAAATGATAAGGACGGGA ATATTTTTGACAGAGCATTAGAATTGATATCTTCTTATGCAGAATACGATACAGAAAGGATATATATCAG GCAAGCGGACATAAACAGAGTTTCTAATGTTATTTTCGGGGAGTGGGAACACTGGGGGGGTTAATGAG GGAATACAAAGCAGACTCTATCAACGACATCAATTTGGAGAGAACATGCAAGAAGGTAGACAAGTGGC TCGACTCAAAGGAGTTTGCGTTATCAGATGTATTAGAGGCAATAAAAAGAACCGGCAATAATGATGCTT TTAATGAATATATCTCAAAGATGCGCACTGCCAGGGAAAAGATTGACGCTGCAAGAAAGGGAAATGAAA TTCATTTCGGAAAAAATATCTGGAGACGAAGAATCGATCCATATTTATCAAAACCTTATTGGCTGGTGC AACAGTTTTTACATTTTTTCAATTTATTCAAAGCGCGTCAGGACATTCCTCTTGATGGAGCATTCTATGCG GAGTTCGATGAAGTCCATAGCAAACTGTTTGCTATTGTTCCGTTGTATAATAAGGTTAGGAACTATCTTA CGAAAAATAACCTTAACACGAAAAAGATAAAGCTAAACTTCAAGAATCCAACTCTGGCAAACGGATGG GATCAAAACAAGGTATATGACTACGCCTCCTTAATCTTTCTCCGCGATGGTAATTATTATCTCGGAATAA TAAATCCAAAAAGGAAAAAGAATATTAAATTCGAACAAGGGTCTGGAAATGGCCCATTCTACCGGAAG ATGGTGTACAAACAAATTCCAGGGCGAACAAGAACTTACCAAGAGTCTTCCTCACATCTACGAAAGGC AAAAAAGAGTACAAGCCGTCAAAGGAGATAATAGAAGGATATGAAGCGGACAAACACATAAGAGGAG ATAAATTCGATCTGGATTTCTGTCATAAGCTGATAGACTTCTTCAAGGAATCCATCGAGAAGGCACAAGG ACTGGAGTAAGTTCAACTTCTATTTCTCTCCAACTGAATCATATGGAGACATCAGCGAATTCTATCTGGA TGTAGAAAACAGGGATACCGGATGCATTTTGAGAATATTTCTGCCGAGACGATTGATGAGTATGTCGA AAAGGGGGACTTATTCCTCTTCCAGATATACAACAAAGACTTTGTGAAAGCGGCAACCGGAAAAAAAG ATATGCACACCATTTATTGGAACGCGGCATTCTCGCCCGAGAACCTTCAGGATGTGGTAGTGAAACTGA ACGGTGAAGCAGAACTTTTCTACAGAGACAAGAGCGACATCAAGGAGATAGTTCACAGGGAGGGAGAG ATACTGGTCAATCGTACCTACAACGGCAGGACACCTGTGCCTGACAAGATCCACAAAAAATTAACAGAT TATCATAATGGCCGTACCAAAGATCTCGGAGAAGCAAAAGAATACCTCGATAAGGTCAGATATTTCAAA GCGCACTACGACATCACAAAGGATCGCAGATACCTGAATGATAAAATATACTTCCATGTGCCTCTGACA TTGAATTTCAAAGCAAACGGGAAGAAGAATCTCAATAAGATGGTAATTGAAAAGTTCCTCTCGGACGAA AAAGCGCATATTATTGGGATTGATCGCGGGGAAAGGAATCTTCTTTACTATTCTATCATTGACAGGTCAG GTAAAATAATCGATCAACAGAGCCTCAACGTCATCGATGGATTCGATTACCGAGAGAAACTGAATCAGA GGGAGATCGAGATGAAGGATGCCAGACAAAGCTGGAATGCTATCGGGAAGTCTATCGGAAGACCTCAAGGAA GGGTATCTTTCAAAAGCGGTCCACGAAATTACCAAGATGGCGATACAATACAATGCCATTGTTGTCATG GAGGAACTCAATTATGGGTTCAAACGCGGACGTTTCAAAGTTGAGAAGCAGATATATCAGAAATTCGAG AATATGCTGATTGACAAGATGAATTATCTGGTATTCAAGGATGCTCCGGATGAAAGTCCGGGAGGAGTC CTCAATGCATATCAGCTTACTAATCCGCTTGAAAGTTTCGCTAAACTTGGGAAACAGACAGGAATTCTTT TCTATGTTCCGGCAGCCTATACTTCGAAGATAGATCCGACGACTGGTTTGTCAATCTTTTTCAATACTTC AAGTAAAAACGAACGCACAGGAAAGAAAAGAATTCTTGCAAAAATTCGAGTCGATCTCCTATTCCGCTAA AGACGGAGGAATATTCGCATTCGCGTTCGATTATCGGAAGTTCGGAACGTCAAAAACAGACCACAAAAA TGTATGGACCGCATACACGAACGGGAAAGGATGAGGTACATAAAAGAGAAAAAACGCAACGAACTGT TCGACCCCTCGAAGGAGATCAAAGAGGCTCTCACTTCATCAGGAATCAAATATGACGGCGGACAGAACA TATTGCCAGATATCCTGAGGAGCAACAATAACGGTCTGATCTACACAATGTATTCCTCTTTCATAGCGGC CATTCAAATGAGGGTCTATGACGGGAAAGAAGACTATATCATCTCGCCGATAAAGAACAGCAAGGGAG AGTTCTTCAGGACCGATCCGAAAAGAAGGGAACTTCCGATAGACGCGGATGCGAACGGCGCGTATAAC ATTGCTCTCAGGGGCGAATTGACGATGCTGCGATAGCGGAGAAGTTCGATCCGGACTCGGAAAAGATG GCGAAGCTAGAACTGAAACATAAGGACTGGTTCGAATTCATGCAGACAAGGGGGGATTGA |
| SEQ ID NO: | ATGACAAAAACATTTGATTCAGAATTTTTTAATTTATATTCTCTTCAAAAAACAGTTCGTTTTGAACTCAA GCCGGTTGGTGAAACAGCCTCGTTTGTTGAAGATTTTAAAAACGAAGGTTTGAAACGAGTTGTTCAGA GGATGAACGGCGTGCGGTTGATTACCAAAAAGTGAAAGAAATTATTGATGACTACCACCGAGATTTTAT |

TABLE 5-continued

| SEQ ID NO | Sequence |
|---|---|
| 24 | TGAAGAATCGCTGAACTATTTTCCTGAGCAGGTCTCAAAAGACGCTTTGGAACAAGCTTTTCACCTTTAT<br>CAAAAACTAAAAGCCGCTAAGGTTGAAGAGCGTGAAAAAGCATTGAAAGAATGGGAAGCCCTTCAGAA<br>AAAACTGCGCGAAAAAGTTGTTAAATGTTTTTCAGATTCAAACAAAGCACGCTTTTCCCGCATTGATAAA<br>AAAGAACTGATTAAAGAAGATTTAATTAACTGGTTGGTTGCACAAAATCGCGAAGATGACATTCCAACC<br>GTTGAAACCTTTAACAACTTTACGACTTATTTTACGGGGTTTCATGAAAACCGAAAAAACATTTATTCAA<br>AAGACGATCATGCCACAGCCATTTCATTTCGACTCATTCATGAAAACCTGCCTAAGTTTTTTGATAATGT<br>GATCAGCTTTAATAAATTGAAGGAAGGATTTCCAGAGCTGAAATTTGATAAGGTTAAGGAAGATTTAGA<br>AGTTGATTATGACTTGAAACATGCCTTTGAAATCGAATACTTTGTCAATTTTGTTACCCAAGCCGGAATT<br>GACCAATATAACTATCTTTTGGGGGTAAAACCTTAGAAGACGGCACCAAAAAGCAAGGCATGAATGA<br>ACAAATCAATCTGTTCAAGCAACAGCAAACCCGAGACAAAGCCCGACAAATTCCCAAACTCATACCATT<br>GTTTAAACAAATTCTAAGCGAACGAACGGAAAGCCAATCGTTTATTCCAAAACAATTTGAATCAGACCA<br>AGAGCTATTTGACTCACTGCAAAAACTGCATAACAACTGCCAAGATAAATTTACCGTACTGCAACAAGC<br>CATTTTAGGCTTAGCCGAAGCAGATCTGAAAAAAGTATTCATTAAAACATCTGATCTTAATGCGCTATCA<br>AATACCATTTTTGGAAATTACAGTGTGTTTTCGGATGCGTTGAATTTATACAAAGAATCGCTCAAAACAA<br>AAAAGGCGCAAGAAGCGTTTGAAAAACTACCCGCTCACAGCATTCATGACTTGATTCAATATTTGGAGC<br>AATTTAATAGCTCTTTGGATGCAGAAAAACAGCAATCAACTGACACCGTACTGAATTACTTTATTAAAAC<br>AGACGAGCTGTATTCTCGGTTCATAAAATCAACGAGCGAAGCCTTCACACAAGTACAACCACTCTTTGA<br>ATTGGAAGCATTAAGCTCAAAACGTCGTCCACCGGAAAGTGAAGACGAAGGCGCAAAAGGTCAGGAAG<br>GGTTTGAGCAAATTAAACGCATAAAAGCCTATTTGGATACCTTGATGGAGGCGGTGCATTTTGCAAAAC<br>CACTTTATCTGGTGAAGGGGCGCAAAATGATTGAAGGTCTGGACAAAGACCAAAGTTTCTATGAAGCCT<br>TTGAAATGGCTTACCAAGAACTAGAAAGTCTGATTATTCCAATCTACAACAAAGCTCGTAGTTATTTAAG<br>TCGTAAACCGTTTAAAGCGGACAAATTCAAAATTAATTTTGATAATAATACATTGCTTTCCGGTTGGGAT<br>GCTAATAAAGAAACGGCTAACGCTTCAATTTTGTTTAAGAAGGATGGTTGTATTATTAGGAATCATGC<br>CTAAAGGAAAAACGTTTTTGTTCGATTACTTCGTTTCATCGGAAGATTCTGAAAAGTTAAAACAAAGAA<br>GACAAAAACCGCCGAAGAAGCGCTTGCGCAAGATGGCGAAAGCTACTTTGAAAAAATTCGTTACAAG<br>CTGTTACCTGGCGCCAGCAAAATGTTGCCGAAAGTATTTTTTTCCAACAAAAACATAGGGTTTTACAACC<br>CAAGTGATGACATACTTCGTATCAGGAATACAGCCTCTCACACTAAAAACGGAACACCGCAAAAAGGGC<br>ACTCTAAAGTAGAGTTTAATTTGAATGATTGTCATAAGATGATTGATTTCTTTAAATCAAGCATTCAAAA<br>GCATCCAGAGTGGGGAAGTTTTGGATTCACCTTTTCAGATACATCAGATTTTGAAGATATGAGCGCCTTT<br>TATCGAGAAGTCGAAAACCAAGGTTATGTCATTAGTTTCGATAAAATAAAAGAAACTTACATTCAGAGT<br>CAAGTTGAACAGGGGAACCTATATTTATTCCAAATCTACAATAAAGACTTCTCGCCCTACAGCAAAGGC<br>AAACCAAATTTACACACGCTTTACTGGAAAGCGTTGTTTGAGGAAGCCAACCTAAATAATGTGGTGGCA<br>AAACTCAATGGTGAAGCTGAAATTTTCTTTAGGCGACACTCAATCAAAGCATCTGATAAAGTGGTGCAC<br>CCAGCGAATCAAGCCATTGACAATAAAAACCCGCATACCGAAAAAACGCAAAGCACCTTTGAATATGAT<br>CTTGTAAAAGACAAGCGCTATACCCAAGACAAATTCTTCTTCCATGTACCGATTTCATTGAACTTTAAGG<br>CACAAGGTGTTTCAAAATTTAACGATAAAGTGAATGGATTTTTAAAGGGTAACCCAGATGTCAATATTA<br>TTGGCATTGACCGAGGCGAACGACACCTTCTGTATTTCACTGTGGTGAATCAGAAAGGTGAAATTTTGGT<br>TCAAGAGTCGCTTAATACCCTAATGAGTGATAAAGGGCATGTGAATGACTACCAGCAAAATCTCGACAA<br>AAAAGAACAAGAACGCGATGCCGCTCGCAAAAGCTGGACGACGGTTGAAAATATCAAAGAATTAAAAG<br>AAGGCTATTTATCTCATGTTGTTCATAAGTTGGCACACCTGATTATTAAATACAATGCCATTGTTTGCTTG<br>GAAGACCTGAATTTTGGTTTCAAACGCGGGCGTTTTAAAGTGGAAAAACAAGTTTATCAGAAATTTGAA<br>AAAGCGCTTATTGATAAGCTTAACTACTTGGTATTTAAAGAAAAAGAGTTAGGCGAGGTGGGCCATTAT<br>CTAACCGCCTATCAGTTGACCGCACCGTTTGAAAGTTTCAAGAAGTTAGGCAAGCAAAGTGGCATATTG<br>TTTTATGTTCCGGCGGATTACACCTCCAAAATTGACCCAACCACCGGGTTTGTCAACTTTCTTGATCTGCG<br>TTATCAGAGTGTCGAAAAAGCCAAACAGCTCTTAAGCGACTTTAATGCCATTCGTTTTAATTCAGTACAA<br>AACTATTTTGAGTTCGAAATAGATTACAAAAAACTCACACCCAAACGTAAAGTTGGTACTCAGAGTAAA<br>TGGGTGATTTGTACCTATGGAGATGTCCGCTATCAAAATCGGCGTAATCAAAAAGGTCACTGGGAAACG<br>GAAGAAGTCAATGTGACTGAAAAACTAAAAGCCCTTTTCGCCAGTGATTCCAAAACTACAACCGTAATC<br>GATTACGCCAATGACGACAACCTAATTGACGTCATTCTGGAACAGGACAAAGCCAGCTTCTTCAAAGAA<br>CTGTTATGGTTATTAAAACTCACCATGACGCTCCGCCACAGCAAAATCAAAAGTGAAGACGACTTTATTC<br>TTTCACCCGTTAAAAACGAACAAGGCGAGTTTTACGATAGTCGAAAAGCGGGCGAGGTGTGGCCTAAAG<br>ATGCAGACGCCAATGGCGCTTATCACATAGCGTTGAAAGGCTTGTGGAATCTGCAACAGATCAATCAGT<br>GGGAAAAGGGTAAAACACTTAATCTGGCGATTAAAAACCAGGATTGGTTCAGTTTTATTCAAGAAAAGC<br>CCTATCAAGAATAA |
| 25 | ATGCACACAGGCGGATTACTTAGCATGGATGCCAAGGAGTTTACCGGACAGTACCCCCTTCGAAGACT<br>CTGCGTTTTGAACTGAGACCGATAGGCAGAACGTGGGACAATCTCGAAGCATCGGGTATCTTGCGGAG<br>GACAGACACCGTGCAGAATGCTATCCCAGGGCAAAAGAGCTCTTGGACGACAACCATCGTGCATTCCTC<br>AACCGTGTCCTGCCTCAGATCGATATGGATTGGCACCCGATCGCAGAGGCATTCTGCAAAGTCCACAAG<br>AATCCGGGAAACAAGGAATTGGCTCAGGATTACAATCTTCAGCTGTCCAAACGCAGAAAGGAGATTTCG<br>GCCTATCTGCAGGATGCGACGGCTATAAAGGTCTGTTTGCCAAACCTGCATTGGATGAAGCAATGAAG<br>ATCGCGAAAGAAACGGAAATGAATCGGACATAGAGGTTCTTGAGGCATTCAACGGTTTCTCCGTATAC<br>TTCACCGGATATCATGAGAGCAGGGAGAACATCTATTCGGACGAGGATGGTGTCGGTAGCTTATCGC<br>ATCACCGAAGACAATTTCCCGAGATTCGTTTCCAATGCGCTTATATTCGATAAGCTGAATGAGTCGCACC<br>CCGATATAATCTCGGAAGTATCCGGAAATCTGGGCGTAGACGACATCGGAAATATTTTGATGTGCTA<br>ACTACAATAATTTCCTGTCGCAGGCCGGTATAGATGACTACAATCACATCATCGGCGGCCATACGACGG<br>AGGACGGTCTGATCCAGGCATTCAATGTTGTTCTGAATCTCAGGCATCAGAAGACCCCGGATTCGAAA<br>AAATCCAATTCAAACAGCTGTACAAACAGATACTCAGCGTCCGTACATCCAAATCCTATATCCCGAAAC<br>AGTTCGATAATTCGAAGGAGATGGTGGACTGCATCTGCGACTATGTGTCCAAGATCGAAAAATCCGAAA<br>CGGTCGAGAGAGCATTGAAGCTGGTAAGGAACATATCTTCTTTTGATTTGCGCGGAATATTCGTAAACA<br>AGAAGAATCTCCGCATTCTTTCCAACAAACTGATTGGTGATTGGGACGCGATCGAAACCGCGCTGACG<br>ACTCCTCCTCTTCGGAAAATGATAAGAAATCCGTCTACGACAGCGCCGAGGCATTTACGCTGGATGATA<br>TCTTTTCGTCCGTTAAAAAATTCTCAGATGCATCTGCAGAGGATATCGGAAACCGGCGGAGGACATAT<br>GCAGAGTCATATCTGAGACCGCTCCGTTCATAAACGATCTGAGGGCTGTCGATTTGGACAGTTTGAATG<br>ACGACGGTTACGAGGCGGCCGGTTTCCAAGATAAGGGAATCTCTGGAACCATATATGGATCTGTTTCATG<br>AACTGGAGATATTCTCCGTAGGCGATGAATTCCCGAAATGTGCAGCTTTCTACAGTGAACTTGAAGAAG |

TABLE 5-continued

| SEQ ID NO | Sequence |
|---|---|
| | TCTCCGAACAGCTAATCGAGATTATACCGTTATTCAACAAGGCCCGTTCGTTCTGTACGCGCAAGAGATA<br>CAGTACGGACAAGATAAAGGTCAATTTGAAATTCCCGACACTCGCCGACGGATGGGATCTCAACAAGA<br>ACGCGACAACAAAGCCGCAATACTCAGGAAAGACGGAAAGTACTACCTGGCCATACTGGATATGAAGA<br>AAGATCTTTCTTCGATCAGAACTTCGGATGAAGACGAATCAGTTTTGAGAAAATGGAGTACAAGCTTC<br>TTCCGAGTCCGGTAAAGATGCTGCCAAAGATCTTCGTAAAATCGAAGGCGGCCAAGGAGAAGTACGGTC<br>TGACCGACCGTATGCTGGAGTGCTACGATAAAGGGATGCACAAGAGCGGCAGTGCATTCGATCTCGGAT<br>TTTGTCACGAATTGATCGATTACTACAAGAGGTGCATCGCAGAATATCCCGGCTGGGACGTCTTCGATTT<br>CAAGTTCAGGGAAACATCGGATTATGGCAGCATGAAGGAGTTCAATGAGGATGTTGCAGGGGCCGGAT<br>ACTATATGTCCCTCAGAAAGATCCCTTGTTCGGAGGTCTACAGGCTTCTTGATGAGAAATCGATATATCT<br>TTTCCAGATCTACAACAAAGATTATTCGGAAAACGCTCATGGGAATAAGAACATGCATACCATGTATTG<br>GGAAGGGCTCTTTTCCCCCCAGAATCTGGAATCCCCTGTGTTTAAACTCAGCGGCGGTGCGGAGCTTTTC<br>TTCCGTAAATCCTCCATACCCAATGACGCCAAAACGGTCCATCCGAAGGGAAGCGTCCTGGTTCCGCGC<br>AATGATGTAAACGGCCGCAGGATACCTGACAGCATATATCGGATCGTCACCAGATATTTCAACCGCGGA<br>GATTGCCGCATAAGCGACGAGGCAAAGAGTTATCTGGACAAGGTGAAAACCAAGAAAGCTGACCACGA<br>TATCGTGAAAGACAGGAGGTTCACGGTGGACAAGATGATGTTCCACGTCCCTATCGCCATGAATTTCAA<br>AGCGATTTCGAAGCCGAATCTCAATAAAAAGGTGATTGACGGCATAATCGACGACCAAGATCTGAAGAT<br>CATCGGCATAGACCGCGGGAGAGCGCAACCTCATCTACGTAACCATGGTGGATCGCAAAGGGAACATCCT<br>CTATCAGGATAGCCTCAATATTCTGAACGGATACGATTACCGTAAGGCCCTCGACGTCCGCGAATATGA<br>CAATAAGAGGCTCGGAGGAACTGGACGAAGGTCGAAGGCATCCGTAAGATGAAAGAGGGGTATCTGT<br>CGCTTGCAGTCAGCAAATTGGCAGATATGATCATAGAGAACAATGCGATTATCGTCATGGAGGATCTCA<br>ATCACGGATTCAAGGCAGGGCGTTCGAAGATAGAGAAACAGGTCTATCAGAAGTTCGAATCCATGCTCA<br>TAAACAAACTCGGTTACATGGTCCTCAAGGATAAGTCTATCGATCAGAGCGGCGGAGCTCTCCACGGAT<br>ACCAGCTTGCCAACCATGTGACAACATTGGCATCTGTAGGTAAACAATGTGGAGTGATATTCTACATCCC<br>TGCTGCATTTACATCCAAGATAGATCCGACAACAGGATTTGCAGATCTGTTCGCCCTCAGCAATGTTAAA<br>AACGTGGCATCTATGAGAGAATTTTTCTCCAAGATGAAGTCTGTAATCTATGATAAGGCGGAGGGAAAA<br>TTCGCATTTACCTTCGACTATCTTGATTATAATGTGAAATCCGAGTGCGGAAGGACCCTTTGGACCGTGT<br>ATACGGTCGGAGAGAGATTCACATACAGCAGGGTCAATAGAGAATATGTCAGAAAAGTTCCGACAGAC<br>ATAATCTACGACGCATTGCAAAAGGCAGGAATATCTGTTGAAGGGGATCTCAGGGACAGGATTGCTGAA<br>TCGGATGGCGACACTCTGAAGAGCATATTCTATGCATTCAAGTATGTCATTGGATATGAGAGTAGAGAAC<br>CGCGAAGAGGATTACATACAGTCTCCTGTCAAAAATGCCTCCGGAGAATTCTTCTGTTCCAAGAACGCA<br>GGCAAATCGCTCCCTCAGGATTCCGATGCGAACGGTGCATACAATATCGCACTCAAGGGGATCCTGCAG<br>CTACGTATGCTTTCCGAGCAGTATGATCCGAATGCAGAGCATACGGTTGCCACTGATAACCAACAAG<br>GCCTGGCTGACCTTTATGCAGTCCGGTATGAAGACATGGAAGAACTGA |
| SEQ ID NO: 26 | atgGATAGTTTGAAAGATTTCACCAATCTGTACCCTGTCAGTAAGACATTGAGATTTGAATTAAAGCCCGT<br>TGGAAAGACTTTAGAAAATATCGAGAAAGCAGGTATTTTGAAAGAGGATGAGCATCGTGCAGAAAGTT<br>ATCGGAGGGTGAAGAAAATAATTGATACTTATCATAAGGTATTTATCGATTCTTCTCTTGAAAATATGGC<br>TAAAATGGGTATTGAGAATGAAATAAAAGCAATGCTCCAAAGTTTCTGCGAATTGTATAAAAAAGATCA<br>TCGCACTGAGGGTGAAGACAAGGCATTAGATAAAATTCGAGCAGTACTTCGTGGCCTGATTGTTGGGGC<br>TTTCACTGGTGTTTGCGAAGACGGGAAATACAGTCCAAAACGAGAAGTACGAGAGTTTGTTCAAAGA<br>AAAGTTGATAAAGAAATTTTACCTGATTTTGTGCTCTCTACTGAGGCTGAAAGCTTGCCTTTCTCTGTTG<br>AAGAAGCTACGAGGTCACTGAAGGAGTTTGATAGCTTTACATCCTACTTTGCTGGTTTTTACGGAATAG<br>AAAGAATATATACTCGACGAAACCTCAATCCACTGCCATTGCTTATCGTCTTATTCATGAGAACTTGCCG<br>AAGTTCATTGATAATATTCTTGTTTTTCAGAAGATCAAAGAGCCTATAGCCAAAGAGCTGGAACATATTC<br>GTGCGGACTTTTCTGCCGGGGGGTACATAAAAAAGGATGAGAGATTGGAGGATATTTTTCGTTGAACT<br>ATTATATCCACGTGTTATCTCAGGCTGGGATCGAAAAATATAACGCATTGATTGGGAAGATTGTGACAG<br>AAGGAGATGGAGAGATGAAAGGGCTCAATGAACACATCAACCTTTACAACCAACAAAGAGGCAGAGAG<br>GATCGGCTCCCTCTTTTTAGGCCTCTTTATAAACAGATATTGAGTGACAGAGAGCAATTATCATACTTGC<br>CTGAGAGTTTTGAAAAGATGAGGAGCTCCTCAGGGCTCTAAAAGAGTTCTATGATCATATCGCAGAAG<br>ACATTCTCGGACGTACTCAACAGTTGATGACTTCTATTTCGAAAGGAAAGGACCACATGGTCTATCTAAT<br>CTCGTTGAGAACGTTTTTGCCTCATACCATGAAGCAGAGCAATTGTTGAGCTTTCCATACCCCGAAGAGA<br>ATAATCTGATTCAGGACAAGGACAATGTGGTGTTAATTAAGAATCTTCTCGACAATATCAGTGATCTGCA<br>GAGGTTCTTGAAACCTCTTTGGGGTATGGGAGACGAACCCGATAAAGATGAAAGATTTATGGAGAGTA<br>TAATTATATCCGAGGAGCTCTAGATCAGGTGATCCCTCTGTACAATAAGGTAAGGAACTACCTCACTCG<br>GAAGCCTTATTCGACCAGAAAAGTAAAACTCAATTTTGGGAATTCTCAATTGCTTAGTGGTTGGGATAG<br>AAATAAGGAAAGGATAATAGCTGTGTGATTTTGCGTAAGGGGCAGAACTTCTATTTGGCTATTATGAA<br>CAATAGGCACAAAAGAAGTTTCGAAAACAAGGTGTTGCCCGAGTATAAGGAGGGAGAACCTTACTTCG<br>AAAAGATGGATTATAAATTTTTGCCTGATCCTAATAAAATGCTTCCTAAGGTTTTTCTTTCGAAAAAAGG<br>AATAGAGATATACAAACCAAGTCCGAAGCTTTTAGAACAATATGGAGACTCACAAAAAGGGGA<br>ATACCCTTTAGTATGGATGATTTGCACGAACTGATCGATTTCTTCAAACACTCAATCGAGGCTCATGAAGA<br>TTGGAAGCAATTCGGATTCAAATTTTCTGATACGGCTACTTATGAGAATGTATCTAGTTTCTATAGAGAA<br>GTTGAGGATCAGGGGTATAAGCTCTCTTTCCGAAAAGTTTCGGAATCTTATGTCTATTCATTAATAGATC<br>AAGGCAAGTTGTATTTATTTCAGATATACAACAAGGACTTTTCTCCCTGCAGCAAAGGGACACCTAATCT<br>GCATACCTTGTATTGGAGAATGCTTTTTGACGAGCGCAATTTGGCAGATGTCATATACAAACTGGATGGG<br>AAGGCTGAAATCTTTTCCGAGAGAAGAGTTTGAAAAATGATCATCCCACGCATCCGGCTGGTAAGCCT<br>ATCAAAAAGAAAGTCGACAAAAAAAAGGAGAGGAGAGTCTGTTTGAGTATGATTTAGTCAAGGATAG<br>GCACTATACGATGGATAAGTTCCAGTTTCATGTGCCTATCTGAAATTTTAAATGTTCTGCAGGAAGC<br>AAAGTCAATGATATGGTTAATGCTCATATTCGAGAGGCAAAGGATATGCATGTCATTGGAATTGATCGT<br>GGAGAACGCAATCTGCTGTATATATGCGTGATAGATAGTCGAGGGACGATTTGGATCAAATTTCTCTG<br>AATACGATTAACGATATAGACTATCATGATTTATTGGAGAGTCGAGACAAAGACCGTCAGCAGGAGCGC<br>CGAAACTGGCAAACTATCGAAGGGATCAAGGAGCTAAAACAAGGCTACCTTAGTCAGGCGGTTCATCG<br>GATAGCCGAACTGATGGTGGCTTATAAGGCTGTAGTTGCTTTGGAGGATTTGAATATGGGGTTCAAACG |

TABLE 5-continued

| SEQ ID NO | Sequence |
|---|---|
| | TGGGCGGCAGAAAGTAGAAAGTTCTGTTTATCAGCAGTTTGAGAAACAGCTGATAGATAAGCTCAACTA<br>TCTTGTGGACAAGAAGAAAAGGCCTGAAGATATTGGAGGATTGTTGAGAGCCTATCAATTTACGGCCCC<br>ATTTAAGAGTTTTAAGGAAATGGGAAAGCAAAACGGCTTCTTGTTTTATATCCCGGCTTGGAACACGAG<br>CAACATAGATCCGACTACTGGATTTGTTAATTTATTTCATGCCACGATTGTAGATAAAGCGAAG<br>AGCTTCTTTCAAAAGTTTGATTCAATTAGTTACAACCCGAAGAAAGACTGGTTTGAGTTTGCATTCGATT<br>ATAAAAACTTTACTAAAAAGGCTGAAGGAAGTCGTTCTATGTGGATATTATGCACACATGGTTCCCGAA<br>TAAAGAATTTTAGAAATTCCCAGAAGAATGGTCAATGGGATTCCGAAGAATTCGCCTTGACGGAGGCTT<br>TTAAGTCTCTTTTTGTGCGATATGAGATAGATTATACCGCTGATTTGAAAACAGCTATTGTGGACGAAAA<br>GCAAAAAGACTTCTTCGTGGATCTTCTGAAGCTATTCAAATTGACAGTACAGATGCGCAACAGCTGGAA<br>AGAGAAGGATTTGGATTATCTAATCTCTCCTGTAGCAGGGGCTGATGGCCGTTTCTTCGATACAAGAGA<br>GGGAAATAAAAGTCTGCCTAAGGATGCAGATGCCAATGGAGCTTATAATATTGCCCTAAAAGGACTTTG<br>GGCTCTACGCCAGATTCGGCAAACTTCAGAAGGCGGTAAACTCAAATTGGCGATTTCCAATAAGGAATG<br>GCTACAGTTTGTGCAAGAGAGATCTTACGAGAAAGACtga |
| SEQ ID NO: 27 | atgaataatggaacaaataactttcagaattttatcggaatttcttctttgcagaagactcttaggaatgctctcattccaaccgaaacaacacagcaa<br>tttattgttaaaaacggaataattaaagaagatgagctaagaggagaaaatcgtcagatacttaaagatatcatggatgattattacagagggtttcatt<br>tcagaaaacttttatcgtcaattgatgatattgactggacttctttattttgagaaaatggaaattcagttaaaaaatggagataacaaagacactcttata<br>aaagaacagactgaataccgtaaggcaattcataaaaaatttgcaaatgatgatagattttaaaaatatgttcagtgcaaaattaatctcagatattctt<br>cctgaatttgtcattcataacaataattattctgcatcagaaaaggaagaaaaacacaggtaattaaattattttccagatttgcaacgtcattcaagg<br>actattttaaaaacagggctaattgttttttcggctgatgatatatcttcatcttcttgtcatagaatagttaatgataatgcagagatatttttagta<br>atgcattggtgtataggagaattgtaaaaagtctttcaaatgatgatataaatataaaatcatccggagatgatgaaggattcattaaaggaaatgtctctgg<br>aagaaaatttattcttatgaaaaatatgggaaattcattacacaggaaggtatatctttttataatgatatatgtggtaaagtaaattcatttatgaatt<br>tatattgccagaaaaataaagaaaacaaaaatctctataagctgcaaaagcttcataaacagatactgtgcatagcagatacttcttatgaggtgccgt<br>ataaatttgaatcagatgaagaggtttatcaatcagtgaatggatttttggacaatattagttcgaaacatatcgttgaaagattgcgtaagattggag<br>acaactataacggctacaatcttgataagatttatattgttagtaaattctatgaatcagttcacaaaagacatatagagattgggaaacaataaata<br>ctgcattagaaatttcattacaacatatattacccggaaatggtaaatctaaagctgacaaggtaaaaaaagcggtaaagaatgatctgcaaaaaagca<br>ttactgaaatcaatgagcttgttagcaattataaattatgtcggatgataatattaaagctgagacatatatacatgaaatatcacatattttgaata<br>attttgaagcacaggagcttaagtataatcctgaaattcatctggtggaaagtgaattgaaagcatctgaattaaaaaatgttctcgatgtaataatga<br>atgcttttcattggtgttcggttttcatgacagaggagctggtagataaagataataattttatgccgagttagaagagatatatgacgaaatatatc<br>cggtaatttcattgtataatcttgtgcgtaattatgtaacgcagaagccatatagtacaaaaaaattaaattgaattttggtattcctacactagcgg<br>atgatggagtaaaagtaaagaataatgtaataatgcaattattctcatgcgtgataattttgtactatttaggaatatttaatgcaaaaaataagcctg<br>acaaaaagataattgaaggtaatacatcagaaaataaagggggattataagaagatgatttataatcttctgccaggaccaaataaaatgatccccaagg<br>tattcctctcttcaaaaaccggagtggaaacatataagccgtctgcctatatattggagggctataaacaaaacaagcatattaaatcctctaaggatt<br>ttgatataaactttttgtcacgatttgattgattattttaagaactgtatagcaatcacctgaatggaagaattttggcttttgattttttctgacacct<br>ccacatatgaagatatcagccgattttacagagaagtcgaattacaaggttataaaatcgactggacatatatcagcgaaaaggatattgatttgttgc<br>aggaaaaaggacagttatatttattccaaatataacaaagatttttccaagaaaagtaccggaaatgataatcttcatactatgtattgaagaatt<br>tgtttagtgaagagaatttaaaggatattgtactgaaatttaaacggtgaggcggaaatcttcttagaaaatcaagcataaagaatccaataattcata<br>aaaaaggctctattcttgttaatagaacatatgaagcgaagggaaaagtcaatttggaaatatccagatagtcagaaaaaacataccggaaaatatat<br>atcaggagctttataaaatatttcaatgataaaagtgataaagaaacttctcggatgaagcagctaagcttaagaatgtagtaggtcatcatgaggctgcta<br>caaacatagtaaaagattatagatatacatatgataaatattttcttcatatgcctattacaatcaattttaaagccaataagacaggctttattaatg<br>acagaatattacaatatattgctaaagaaaaggatttgcatgtaataggcattgatcgtggtgaaagaaacctgatatatgtttcagtaattgatactt<br>gtgaaatattgttgaacaaaatcgtttaacattgttaatggatatgattatcagattaagctcaagcagcaggagggggcgcgacaaatcgcacgaaa<br>agaatggaaagaaatcggcaaaatAAAAgaaattaaagaaggctatttatctcttgtaattcatgaaattcaaagatggttattaaatataatgccat<br>aattgcaatggaggatttaagctacggatttaaaaaaggtcgtttcaaggttgagcgacaggtttaccagaagtttgagacaatgcttatcaacaaact<br>caactatctggtatttaaagatatatccataacggaaaacggtggtcttctaaagggataccagcttacatatattccagataaactgaaaaatgtggg<br>tcatcaatgtggctgtatattttatgtacctgctgcctatacatcaaaaatagatcctacaaccggattttgtaaatatattcaaatttaaagattaac<br>agttgatgcgaagagaattttataaaaaattttgacagtatcagatatgattcagaaaaaaatctgttttgttttacattcgattataataacttttat<br>tacgcaaaatactgttatgtcaaagtcaagcggagtgtatatacgtacggagttaggataaaagaagatttgtcaatggcaggttctcaaatgaatc<br>ggatacaattgatataacaaaagatatggaaaaacactcgaaatgacagatataaattggagagatggtcatgatctgaggcaggatattattgatta<br>tgaaatcgtacaacacatatttgagattttttagattgactgtacaaatgagaaacagtttaagtgaattagaagacagggattatgaccgtttgatttc<br>tccggtgctcaatgaaaataatatattttatgattcagctaaagcaggagatgcgttacctaaagacgcagatgctaatggtgcatattgtatagctct<br>aaaaggcttgtatgaaatcaaacaaatttacagagaattggaaagaagacggtaagttttcaagagatataacttaaaattccaataaggactggtttga<br>ctttattcaaaataaaaggtatttataa |
| SEQ ID NO: 28 | atgacaaacaaatttacaaaccagtactcgctttccaaaacacttcgatttgagttgattccacaaggaaaaacattggaatttattcaagaaaaagga<br>ttgctctctcaagataaacaacgagcggagagttatcaagaaatgaaaaaaactattgataaatttcataaatactttatcgatttagctttaagcaat<br>gctaaactaactcatttagaaacttacttggaattatacaataaaagtgctgaaacaaaaaagaacaaaaatttaaagacgatttaaagaaagtacaa<br>gacaatttacgaaaagaaatcgttaaatcttttttcagatggtgatgcaaaatcaattttttgcaattttggataaaaagaactgattaccgtagaactt<br>gaaaaatggtttgaaaacaacgaacaaaaagacatttatttttgcagcaaaaattcaaaacgtttactacttattttactggttttcatcaaaacagaaaa<br>aacatgtattcggttgaacccaattctacagcaattgcttttcgattgattcatgaaaatttacctaaatttagaaaatgctaaagcatttgaaaaaa<br>taaaacaagtagaaagtttgcaagttaattttagagaattaatgggggaataggagatgaagggctaattttcgtaaatgaattagaagaaatgtttca<br>aatcaattattataatgatgtgctttcacaaaatggaattacaatttataatagtataattcaggatttaccaaaaatgatataaaatataaaggtct<br>aaatgaatacataaataattacaaccaaagacaaaaaagaccgtttgccaaaatTAAAACAATTGTATAAACAGATtttgagtgataggatttc<br>acttcgttttttgcccgatgcttttacggatgggaaacaagttttgaaagccatatttgacttttataaaatcaacttacttttcttataccattgaagg<br>acaggaagaaagccaaatctttttactattaattcgtcagacaattgaaaacctttctagttttgatacccaaaaatttatctaaaaaatgataccca<br>tttaaccactatttcacaacaagtatttggcgattttcggtgttttcaactgctttaaattattggtatgaaactaaagtaaatccaaatttgaaac<br>ggaatatagcaaagccaacgaaaaaaaacgagaaattttagataaagccaaagtatttacaaaacaagattattttcaattgcttttttacaaga<br>agtactttcggaatacattcttacctttagatcacacttctgatattgtaaaaagcatttcctccaactgtattgcggatttttaaaaatcattttgtag<br>ccaaaaaagaaaatgaaaccgacaaaaccctttgattttattgctaatattactgcaaaataccaatgtattcaaggtatttagaaaatgcagaccaat<br>aacgaagacgaactcaacaagaccaaaaattaattgataatttgaaattcttttttagatgctatttagaattgttgcattttattaaacctttgcatt<br>taaaatcagaaagcattaccgaaaagactgcttttttatgatgtgtttgaaaattattacgaagcattgagttttgttgacccatatcaatatatggg<br>tgcgaaactatgtaacgcaaaagccgtacagcaccgaaaaaattaaaatttaaatttttgaaaatgcacaattattgaatggttgggatgccaataagaag<br>gtgattacctaactaccattttgaaaaagacggtaattattttttagccataatggataaaaagcataacaaagcgtttcaaaagtttccagaaggaa<br>aagaaaattatgaaaaaatggtgtataaaactattgcctggagtaaataagatgttgccaaaagtatttttttccaataaaaatattgcttacttcaacc<br>catcaaaagagttattagaaaactataaaaaagagacgcacaaaaaaggagacacattcaatttagaacattgtcatacgttgatcgatttttcaagg<br>actcttaaacaaacatgaagactggaaatactttgattttcaattttctgaaacaaaatcgtatcaagattTGagtggttttatagagaagtagaac |

TABLE 5-continued

| SEQ ID NO | Sequence |
|---|---|
| | atcaaggctacaaaatcaattttaaaaatatcgattcagaatatattgatggtttggtgaacgaaggtaaattgtttctatttcaaatttacagcaaag<br>attttcgcctttttccaaagggaaaccgaacatgcacactttgtattggaaagccttatttgaagaacaaaatttgcaaaatgtaatctataaattga<br>atggacaagccgaaatatttttagaaaagcctctataaaacctaaaaatataatattgcacaaaagaaaattaaaattgccaaaaagcattttattg<br>ataaaaaaacaaaaacatctgaaattgttcctgttcaaacaataaaaaacctcaatatgtactaccaaggaaaaataagtgaaaaagaattaacacaag<br>atgatttaaggtatattgataatttttagcattttcaatgaaaaaaataaaacaattgatattataaaagacaaacgatttacggttgataaatttcagt<br>ttcatgtgccgattaccatgaactttaaagcaacgggcggaagttatatcaatcaaaccgtattagaatatttgcaaaacaatcccgaagttaagatta<br>ttggattggatagaggcgaacgccatttggtatatctgacactgatagaccagcaaggaaacatcttgaaacaagaaagtttgaatacaatcaccgatt<br>ctaaaatctcgacacctatcataagttgttggataacaaggaaaacgagcgtgacttggctcgaaaaaatggggaacggtggaaaacatcaaagaac<br>tcaaagaaggctacatcagtcaagtggtgcataaaattgctacgttgatgctggaagaaaatgccattgtggtaatggaagatttgaattttggattta<br>aacgtggacgttttaaagtggaaaaacaaatttatcaaaagctggaaaaatgttgattgacaaattgaattatttggttttaaaagacaaacaacctc<br>aggaattaggcggattgtacaacgcattacaactcaccaataaatttgaaagtttccaaaaaatgggtaaacaatcgggcttttgttttatgtacccg<br>cttggaacacctccaaaatagacccaaccacagggtttgtcaattattttataccaaatatgaaaatgttgacaaagccaaagcctttttgaaaaat<br>ttgaggcgattcgtttcaatgcagaaaagaagtattttgaattttgaagtgctaaaaaatatgaaaatgccgaaggcactcaacaagcct<br>ggaccatttgcacgtatggcgaacgaatagaaaaccaaacgacaaaaagaccaaaacaacaaatttgtaagcactccaattaatctaaccgaaaagatag<br>aagactttttgggtaaaaaccaaattgtttatggtgatggtaattgcatcaaatctcaaattgctagcaaagacgacaaggcttttttttgaaaccttat<br>tgtattggttcaaaatgacttacaaatgcgaaacagcgaaacaagaacagatatagattatctaatttcgcccgtgatgaatgacaacggaacatttt<br>acaacagccgagattatgaaaaattagaaaatccaactttgcccaaagatgccgatgccaacgagcgtatcatattgccaaaaaggattgatgcttt<br>tgaataaaaatagaccaagccgacttgacaaaaaaagtggatttatctattagtaacagagattggttgcaatttgtacaaaaaataaataa |
| SEQ ID NO: 29 | atggaacaggagtactatttaggactggatatgggaaccggatctgtaggatgggctgttacagattcggaatatcatgtcttgcgtaaacatggaaaa<br>gcactatggggagtccgattgtttgaaagtgcatcgacagcagaagaacgaagaagtgttccgaacatcaagaagaagactagatcgaagaaactggaga<br>attgaaattttacaggaaattttttgcagaggaaataagtaagaaaagatccaggattttcttgcgaatgaaagaaagcaaatattatccagaagataag<br>cgagatatcaatgcgaaattgtccggaactgccatatgcattatttgttgatgacgattttacagataaagattatcataaaaaatttccgacaatttat<br>catctcaggaaaatgttgatgaatacagaggagacaccggatatccggttggtgtatctggcaattcatcatatgatgaagcataggggccatttcttg<br>ttatctggtgacattaatgatgagattaaggagttcggaacgacattttcaaaattgttggagaatatcaaaaatgaggaattggattggaatcttgaactg<br>ggaaaagaagaatatgctgttgtagaaagtattttaaaagataacatgtttaaaccgatccacaaagaaaaccagattaataaaagcattaaaagcaaa<br>tcaatatgtgaaaggctgtactgaatttattggctggtggaacggtgaaattgagtgatatatttggtcttgaagaattaaatgagacagaaagaccg<br>aagatttcctttgctgataatggatacgatgattatatcggagaagttgaaaatgagctgggagaacaattctatattatagagacggcaaaagcagtg<br>tatgactgggcggtattagttgaaatattgggaaaatatacgtcaatttcagaagcgaaagtagcaacgtatgaaaaacataaatcggatttacaatttt<br>ttgaaaaagatagttcggaaatatctgacaaaggaggaatataaagatattttttgtaagtacgagtgacaaattgaaaaattactctgcttatagga<br>atgacgaaaataaatggaaaaaggttgatttgcagacaaacggtgcagtaaaagaagaattctatgattttattaagaaaaacgtacttaaaaagcta<br>gaaggacaacctgaatatgaatatttgaaagaagagctagaaagagaaacatttctaccaaaacaggtgaacagggataatggtgtaataccgtatcag<br>attcatttgtacgagttgaaaaagatattaggaaatttacgggataaaatagacctcattaaagagaacgaagtaaactggttcaattatttgaattc<br>agaattccgtattatgttggtccgctgataagatagatgacggaaaagggaaaatttacatgggctgtacggaaaagtaatgaaaagatatatcca<br>tggaattttgaaaatgtagttgatatagaagcaagtgcagaaaaattatccggagaatgacaataagtgtacatatctgatgggcgaagatgtattg<br>ccgaaggattcattgcttacagtaaatatggttttaaatgaattaaataatgtaaagttggatggcgaaaatttatctgtagaattgaaacaacgg<br>ttgtatacagatgtattttgtaagtatcggaaagtaactgtaaagaagataaaaaattacttgaaatgtgaaggtatcatatccggcaatgtcgaaata<br>actggaattgatggtgattttaaggcatcgttaacggcatcatgattttaaagaaaatcttgacaggaacagatttggctaaaaaggacaaagaaaat<br>attattaccaatagtattgtttggagatgataaaaagctgctgaaaaagagactgaatcgattatatcctcagattacgccgaatcagttgaagaaa<br>atatgtgcgctatcctatacaggctggggaagatttctaaaaagttcttagaagaaataacagctccagatccggaaacgggagaggtatggaatatc<br>attacggcattgtgggaatcgaataataatctgatgcaattattaagtaatgaatatcggtttatggaagaagtcgaaacatacaatatgggaaaacag<br>actaaacattgtcgtacgaaacagtagagaatatgtatgtttctccatctgtgaaaagacagatatggcgagcgtacagaaatcgtgaaagaattagaa<br>aaagtaatgaaagaatctccgaaacgtgtatttattgagatggcgagaaagcaagaaagtaagagaaccgaatcgcgtaaaaaacaactaatagat<br>ttgtataaggcttgtaaaaatgaagaaaaagattgggtaaaagaactgggagatcaggaagaacagaaattacgaagcgataagttgtacctatattat<br>acgcaaaagggtcgttgtatgtattctggcgaggtaatagaactgaaagacttatgggataatacaaaatatgatattgatcatatatatccacaatct<br>aaaacgatggatgacagtcttaatatcgcgtattggtaaagatgtattaagaattataatgcaacaaaatcagataagtatccattaaatgaaaatatacgacat<br>gagagaaaaggcttttggaagtcactgttagtggagggtttataagtaaagaaaaatgaacgcttaataagaaatacagaattgagtccggaagaa<br>ttagcaggatttattgaaaggcagattgttgaaacgaggcagagtacaaaagctgtagcggaaatattaaagcaagtgtttccggaaagtgaaattgta<br>tatgtcaaagcaggtacggtttcaagattcagaaaagattttgaattactgaaagttcgagaagtgaatgatttgcatcacgcaaaggatgcgtattta<br>aatattgtagttggtaatagttattatgtgaaattactaagaatgcatcatgtttaaaaagaaaatccgggacgtacttacaacttaaaaaagatg<br>tttacatcaggttggaatatgaacgaaatggagaagttgcatgggaagtcggtgaaaaaagaaaatcttgtaacggtaaaacaaataatgaataaaat<br>aatatattggtgacaagacaggttcatgaagcgaaaggtgggctgtttgatcagcagattatgaaaaaaggaaaagtcagattgctataaaaggaaact<br>gatgaacgtcttgcatcaatagaaaaagtatggaggctataataaagctgccggggcatattttatgctggtagaatctaaagataaaaaaaggaaaaca<br>attcgaacgatagaatttataccattatatttaaagaataaaatcgagtcggatgaatcaatagcattgaacttttagaaaaaggcagaggtttgaaa<br>gaaccaaagatactattgaaaaaaaattaagattgatacatttatttgatcggcagttcaaaatgtggttgtcgtggaagaacagggggacagactacta<br>tttaaatgtgcaaatcaattgattttggatgagaaaataattgtaacaatgaaaaaaatttgtaaagtttattcaaaggagacaaggaaaatagagaatta<br>aaattatctgataaagatggaattgataatgaagtacttatgaaatatataacactttgtggataagttagaaaacacagtgtatagaatacgatta<br>tccgaacaggcaaaaacgcttatagataaacaaaagagaatttgaaaggtatcactagaggataaaagtagtactttgttgaaattttacatattttt<br>cagtgtcaaagtagtgcggccaatttaaaaatgataggcggacctggaaaagcaggaatattagttatgaataataatataagtaagtgaacaaaatt<br>tctattataaatcagtctccaacaggaattttcgaaaatgagattgatttgttaaagat |
| SEQ ID NO: 30 | ATGAAATCTTTCGATTCATTCACAAATCTTTATTCTCTTTCAAAAACCTTGAAATTTGAGATGAGACCTGT<br>CGGAAATACCCAAAAATGCTCGACAATGCAGGAGTATTTGAAAAAGACAAACTAATTCAAAAAAGT<br>ACGGAAAAACAAAGCCGTATTTCGACAGACTCCACAGAGAATTTATAGAAGAAGCGCTCACGGGGGTA<br>GAGCTAATAGGACTAGATGAGAACTTTAGGACACTTGTTGACTGGCAAAAAGATAAGAAAAATAATGTC<br>GCAATGAAAGCGTATGAAAATAGTTTGCAGCGGCTGAGAACGGAAATAGGTAAAATATTTAACCTAAA<br>GGCTGAGGATTGGGTAAAGACAAATATCCAATATTAGGGCTGAAAAATAAAAATACCGATATTTTATT<br>CGAAGAGGCTGTATTCGGGATATTGAAAGCCCGATATGGAGAAGAAAAAGATACTTTTATAGAAGTAG<br>AGGAAATAGATAAAACCGGCAAATCAAAGATCAATCAAATATCAATTTTCGATAGTTGGAAGGATTTA<br>CAGGATATTTCAAAAAATTTTTTGAAACCAGAAAGAATTTTTACAAAAACGACGGAACTTCTACAGCAA<br>TTGCTCAAGGATCATTGATCAAAATCTGAAAAGATTCATAGATAATCTGTCAAATAGTTGAAAGTGTGA<br>GACAAAAGGTTGATCTCGCCGAGACAGAAAAATCTTTCAGCATATCTCTATCGCAATTCTTCTCAATAGA<br>CTTTTTATAACAAGTGTCTCCTTCAAGATGGTATTGATTACTACAACAAGATAATCGGTGGAGAAACTCTC<br>AAAAATGGCGAAAAACTAATAGGTCTCAATGAACTAATAAATCAATATAGGCAGAATAATAAGGATCA<br>GAAAATCCCATTTTTCAAACTTCTTGATAAACAAATTTTGAGTGAAAAGATATTATTTTGGATGAAATA<br>AAAAAATGACACAGAACTGATCGAGGCGCTGAGTCAGTTCGCAAAAACAGCCGAAGAAAAACAAAAAT |

TABLE 5-continued

| SEQ ID NO | Sequence |
|---|---|
| | TGTCAAAAAGCTTTTTGCCGATTTTGTAGAAAATAATTCCAAATACGATCTTGCACAGATTTATATTTCC |
| | CAAGAAGCATTCAATACTATATCAAACAAGTGGACAAGCGAAACTGAGACGTTCGCTAAATATCTATTC |
| | GAAGCAATGAAGAGTGGAAAACTTGCAAAGTATGAGAAAAAAGATAATAGCTATAAATTTCCTGATTTT |
| | ATTGCCCTTTCACAGATGAAGAGTGCTTTATTAAGTATCAGCCTTGAGGGACATTTTTGGAAAGAGAAAT |
| | ACTACAAAATTTCAAAATTCCAAGAAGACCAATTGGGAGCAGTTTCTTGCAATTTTTCTATACGAGTT |
| | TAACTCTCTTTTCAGCGACAAATAAATACAAAAGATGGAGAAACAAAGCAAGTTGGATACTATCTATT |
| | TGCCAAAGACCTGCATAATCTTATCTTAAGTGAGCAGATTGATATTCCAAAAGATTCAAAAGTCACAAT |
| | AAAAGATTTTGCCGATTCTGTACTCACAATCTACCAAATGGCAAATATTTTGCGGTAGAAAAAAAACG |
| | AGCGTGGCTTGCCGAGTATGAACTAGATTCATTTTATACCCAGCCAGACACAGGCTATTTACAGTTTTAT |
| | GATAACGCCTACGAGGATATTGTGCAGGTATACAACAAGCTTGAAACTATCTGACCAAAAAGCCATAT |
| | AGCGAGGAGAATGGAAGTTGAATTTTGAAAATTCTACGCTGGCAAATGGATGGGATAAGAACAAAGA |
| | ATCTGATAATTCAGCAGTTATTCTACAAAAAGGTGGAAAATATTATTTGGGACTGATTACTAAAGGACA |
| | CAACAAAATTTTTGATGACCGTTTTCAAGAAAAATTTATTGTGGAATTGAAGGTGGAAAATATGAAAA |
| | AATAGTCTATAAATTTTTCCCCGACCAGGCAAAATGTTTCCCAAAGTGTGCTTTTCTGCAAAAGGACTC |
| | GAATTTTTTAGACCGTCTGAAGAATTTTAAGAATTTATAACAATGCAGAGTTAAAAAAGGAGAAACT |
| | TATTCAATAGATAGTATGCAGAAGTTGATTGATTTTTATAAAGATTGCTTGACTAAATATGAAGGCTGGG |
| | CATGTTATACCTTTCGGCATCTAAAACCCACAGAAGAATACCAAAACAATATTGGAGAGTTTTTTCGAG |
| | ATGTTGCAGAGGACGGATACAGGATTGATTTTCAAGGCATTTTCAGATCAATATATTCATGAAAAAACG |
| | AGAAAGGCGAACTTCACCTTTTTGAAATCCACAATAAAGATTGGAATTTGGATAAGGCACGAGACGGAA |
| | AGTCAAAAACAACACAAAAAAACCTTCATACACTCTATTTCGAATCGCTCTTTTCAAACGATAATGTTGT |
| | TCAAAACTTTCCAATAAAACTCAATGGTCAAGCTGAAATTTTTATAGACCGAAAACGGAAAAGACAA |
| | ATTAGAATCAAAAAAAGATAAGAAAGGGAATAAAGTGATTGACCATAAACGCTATAGTGAGAATAAGA |
| | TTTTTTTTTCATGTTCCTCTCACACTAAACCGCACTAAAAATGACTCATATCGCTTTAATGCTCAAATCAAC |
| | AACTTTCTCGCAAATAATAAAGATATCAACATCATCGGTGTAGATAGGGGAGAAAAGCATTTAGTCTAT |
| | TATTCGGTGATTACACAAGCTAGTGACATCTTAGAAAGTGGCTCACTAAATGAGCTAAATGGCGTGAAT |
| | TATGCTGAAAAACTGGGAAAAAAGGCAGAAAATCGAGAACAAGCACGCAGAGACTGGCAAGACGTAC |
| | AAGGGATCAAAGACCTCAAGAAAGGATATATTTCACAGGTGGTGCGAAAGCTTGCTGATTTAGCAATTA |
| | AACACAATGCCATTATCATTCTTGAAGATTTGAATATGAGATTTAAACAAGTTCGGGGCGGTATCGAAA |
| | AATCCATTTATCAACAGTTAGAAAAAGCACTGATAGATAAATTAAGCTTTCTTGTAGACAAAGGTGAAA |
| | AAAATCCCGAGCAAGCAGGACATCTTCTGAAAGCATATCAGCTTTCGGCCCCATTTGAGACATTTCAAA |
| | AAATGGGCAAACAGACGGGTATAATCTTTTATACACAAGCTTCGTATACCTCAAAAGTGACCCTGTAA |
| | CAGGTTGGCGACCACACCTGTATCTCAAATATTTCAGTGCCAAAAAGCAAAAGACGATATTGCAAAGT |
| | TTACAAAAATAGAATTTGTAAACGATAGGTTTGAGCTTACCTATGATATAAAGGACTTTCAGCAAGCAA |
| | AAGAATATCCAAATAAAACTGTTTGGAAAGTTTGCTCAAATGTAGAAGAGATTCAGGTGGGACAAAACC |
| | TCAATCAAAACAAAGGCGGATATACTCACTACACAAATATAACTGAGAATATCCAAGAGCTTTTTACAA |
| | AATATGGAATTGATATCACAAAAGATTTGCTCACACAGATTTCTACAATTGATGAAAACAAAATACCT |
| | CATTTTTTAGAGATTTTATTTTTTATTTCAACCTTATTTGCCAAATCAGAAATACCGATGATTCTGAGATT |
| | GCTAAAAGAATGGGAAAGATGATTTTATACTGTCACCTGTTGAGCCGTTTTTCGATAGCCGAAAAGAC |
| | AATGGAAATAAACTTCCTGAGAATGGAGATGATAACGGCGCGTATAACATAGCAAGAAAAGGGATTGT |
| | CATACTCAACAAAATCTCACAATATTCAGAGAAAACGAAAATTGCGAGAAATGAAATGGGGGGATT |
| | TGTATGTATCAAACATTGACTGGGACAATTTTGTAACCCAAGCTAATGCACGGCATTAA |
| SEQ ID NO: 31 | ATGATTATCTTATATATTAGTACCTCGAATATGAACATGGAAGGAGTATTTATGGAAAATTTTAAAAACT |
| | TGTATCCAATAAACAAACACTTCGATTTGAATTAAGACCCTATGGAAAAACATTGGAAAATTTTAAAA |
| | AATCCGGACTTTTAGAAAAGATGCCTTTAAGGCAAATAGTAGACGAAGTATGCAAGCTATAATCGATG |
| | AAAAATTCAAAGAGACTATCGAAGAACGCTTAAAGTACACTGAATTATTCGGTGAATGTGATCTTGGAAACA |
| | TGACATCAAAAGATAAAAAATAACTGATAAAGCAGCTACAAATTTAAAAAAGCAAGTTATCTTATCTT |
| | TTGACGATGAAATATTTAATAATTACCTAAAACCTGATAAAAATATTGACGCATTATTTAAAAATGATCC |
| | TTCAAATCCTGTAATCTCTACATTTAAAGGTTTTACGACATATTTTGTGAATTTTTTGAAATTCGAAAAC |
| | ATATTTTCAAGGGAGAATCATCAGGCTCAATGGCATACCGAATTATAGATGAAAACCTGACAACATACT |
| | TGAATAATATTGAAAAATAAAAAAAACTGCCAGAAGAATTAAAATCACAGCTAGAAGGCATTGATCAG |
| | ATTGATAAACTTAATAATTATAATGAGTTCATTACACAGTCAGGTATAACACACTATAATGAAATCATCG |
| | GCGGTATATCAAAATCAGAGAATGTCAAAATACAGGGAATTAATGAAGGAATTAATCTATACTGTCAGA |
| | AGAACAAAGTTAAACTTCCTGACTGTCCGCTATACAAAATGATTATCAGACAGATTTCCAACTC |
| | TTTTGTATTAGACACTATTGAAAATGACACAGAATTAATTGAAATGATAAGTGATTTGATTAATAAGACT |
| | GAGATTTCGCAAGATGTTATAATGTCAGATATTCAAAATATTTTCATAAAATACAAACAACTTGGTAATT |
| | TGCCGGGTATCTCATATTCTTCAATAGTTAATGCTATTTGCTCGGATTATGACAACAATTTCGGAGATGG |
| | GAAGCGAAAAAAATCTTACGAAAATGATCGCAAAAAGCATTTGGAGACTAATGTATACTCCATAAATTA |
| | TATTTCTGAATTGCTTACAGATACCGATGTTTCATCAAATATCAAGATGAGATATAAAGAGCTTGAGCAA |
| | AATTATCAGGTTTGCAAAGAAAATTTTAATGCCACAAACTGGATGAATATTAAAAATATAAAACAATCT |
| | GAAAAAACAAACCTTATTAAAGATTTGTTAGATATACTTAAATCGATTCAACGTTTCTATGATTTGTTTG |
| | ATATTGTTGACGAAGATAAAAATCCAAGTGCTGAATTTTATACCTGGTTATCAAAAAATGCTGAAAAGC |
| | TTGACTTTGAATTCAATTCTGTATATAACAAGTCACGAAACTATCTCCAGGAAACAATACTCTGATAA |
| | AAAAATCAAGCTGAATTTTGATTCTCCAACATTGGCCAAAGGGTGGGATGCTAACAAAGAAATAGATAA |
| | CTCCACGATTATAATGCGTAAATTTAATAATGACAGAGGCGATTATGATTACTTCCTTGGCATATGGAAT |
| | AAATCCACACCTGCAAATGAAAAATAATCCCACTGGAGGATAATGGATTATTCGAAAAAATGCAATAT |
| | AAGCTGTATCCAGATCCTAGTAAGATGTTACCGAAACAATTTCTATGAAAAATATGGAAGGCAAAGCAT |
| | CCTACGACACCTGAATTTGATAAAAAATATAAAGAGGGAAGACATAAAAAAGGTCCTGATTTCGAAAA |
| | AGAATTCCTGCATGAATTGATTGATTGCTTCAAACATGGTCTTGTAATCACGATGAAAATATCAGGAT |
| | GTTTTTGGCTTCAATCTCCGTAACACTGAAGATTATAATTCATATACAGAGTTTCTCGAAGATGTGGAAA |
| | GATGCAATTACAATCTTTCATTTAACAAAATTGCTGATATTCAACCGTTATTAATGGGAAAATGTA |
| | TGTATTTCAGATATGGTCAAAAGACTTTTCTATTGATTCAAAAGGTACTAAAAACTTGAATACAATCTAT |
| | TTTGAATCACTATTTTCAGAAGAAAACATGATAGAAAAATGTTCAAGCTTTCTGGAGAGGCTGAGATA |
| | TTCTATCGACCAGCATCGTTGAATTATTGTGAAGATATCATAAAAAAAGGTCATCACCATGCAGAATTA |
| | AAAGATAAGTTGACTATCCTATAATAAAAGATAAGCGATATTCACAAGATAAGTTTTTCTTTCATGTGC |
| | CAATGGTTATAAATTATAAATCTGAGAAACTGAATTCCAAAAGCCTTAACAACCGAACAAATGAAACC |

TABLE 5-continued

| SEQ ID NO | Sequence |
|---|---|
| | TGGGACAGTTTACACATATTATAGGTATAGACAGGGGCGAGCGGCACTTGATTTATTTAACTGTTGTTGA<br>TGTTTCCACTGGTGAAATCGTTGAACAGAAACATCTGGACGAAATTATCAATACTGATACCAAGGGAGT<br>TGAACACAAAACCCATTATTTGAATAAATTGGAAGAAAAATCTAAAACAAGAGATAACGAGCGTAAAT<br>CATGGGAAGCTATTGAAACTATCAAAGAATTAAAAGAAGGCTATATTTCTCATGTAATTAATGAAATAC<br>AAAAGCTGCAAGAAAAATATAATGCCTTAATCGTAATGGAAAATCTTAACTATGGGTTCAAAAACTCAC<br>GAATCAAAGTTGAAAAACAGGTTTATCAAAAATTCGAGACAGCATTGATTAAAAAGTTCAATTATATTA<br>TTGATAAAAAGATCCAGAAACCTATATACATGGTTACCAGCTTACAAATCCTATTACCACTCTGGATAA<br>GATTGGAAATCAATCTGGAATAGTGCTGTATATTCCTGCGTGGAATACTTCTAAGATAGATCCCGTCACA<br>GGATTTGTAAACCTTCTGTACGCAGATGATTTGAAGTATAAAAATCAGGAGCAGGCCAAATCATTCATT<br>CAGAAAATAGACAACATATATTTTGAAAATGGAGAGTTTAAATTTGATATTGATTTTTCCAAATGGAATA<br>ATCGCTACTCAATAAGTAAAACTAAATGGACGTTAACAAGTTATGGGACTCGCATCCAGACATTTAGAA<br>ATCCCCAGAAAAACAATAAGTGGGATTCTGCTGAATATGATTTGACAGAAGAGTTTAAATTAATTTTAA<br>ATATAGACGGAACGTTAAAGTCACAGGACGTAGAAACATACAAAAAATTCATGTCTTTATTTAAACTAA<br>TGCTACAGCTTCGAAACTCTGTTACAGGAACCGACATTGATTATATGATCTCTCCTGTCACTGATAAAAC<br>AGGAACACATTTCGATTCAAGAGAAATATTAAAAATCTTCCTGCCGATGCAGATGCCAATGGTGCCTA<br>CAACATTGCGCGCAAAGGAATAATGGCTATTGAAAATATAATGAACGGTATAAGCGATCCACTAAAAAT<br>AAGCAACGAAGACTATTTAAAGTATATTCAGAATCAACAGGAATAA |
| SEQ ID NO: 32 | ATGACCCAATTTGAAGGTTTTACCAATTTATACCAAGTTTCGAAGACCCTTCGTTTTGAACTGATTCCCC<br>AAGGAAAAACACTCAAACATATCCAGGAGCAAGGGTTCATTGAGGAGGATAAAGCTCGCAATGACCAT<br>TACAAAGAGTTAAAACCAATCATTGACCGCATCTATAAGACTTATGCTGATCAATGTCTCCAACTGGTAC<br>AGCTTGACTGGGAGAATCTATCTGCAGCCATAGACTCCTATCGTAAGGAAAAAACCGAAGAAACACGA<br>AATGCGCTGATTGAGGAGCAAGCAACATATAGAAATGCGATTCATGACTACTTTATAGGTCGGACGGAT<br>AATCTGACAGATGCCATAAATAAGCGCCATGCTGAAATCTATAAAGGACTTTTTAAAGCTGAACTTTTCA<br>ATGGAAAAGTTTTAAAGCAATTAGGGACCGTAACCACGACAGAACGATGAAAATGCTCTACTCCGTTCGT<br>TTGACAAATTTACGACCTATTTTTCCGGCTTTTATGAAAACCGAAAAAATGTCTTTAGCGCTGAAGATAT<br>CAGCACGGCAATTCCCCATCGAATCGTCCAGGACAATTTCCCTAAATTTAAGGAAAACTGCCATATTTTT<br>ACAAGATTGATAACCGCAGTTCCTTCTTTGCGGGAGCATTTTGAAAATGTCAAAAAGGCCATTGGAATCT<br>TTGTTAGTACGTCTATTGAAGAAGTCTTTTCCTTTCCCTTTTATAATCAACTTCTAACCCAAACGCAAATT<br>GATCTTTATAATCAACTTCTCGGCGGCATATCTAGGGAAGCAGGCACAGAAAAAATCAAGGGACTTAAT<br>GAAGTTCTCAATCTGGCTATCCAAAAAAATGATGAAACAGCCCATATAATCGCGTCCCTGCCGCATCGTT<br>TTATTCCTCTTTTTAAACAAATTCTTTCCGATCGAAATACGTTATCCTTTATTTTGGAAGAATTCAAAAGC<br>GATGAGGAAGTCATCCAATCCTTCTGCAAATATAAAACCCTCTTGAGAAACGAAAATGTACTGGAGACT<br>GCAGAAGCCCTTTTCAATGAATTAAATTCCATTGATTTGACTCATATCTTTATTTCCCATAAAAAGTTAG<br>AAACCATCTCTTCAGCGCTTTGTGACCATTGGGATACCTTGCGCAATGCACTTTACGAAAGACGGATTTC<br>TGAACTCACTGGCAAAATAACAAAAGTGCCAAAGAAAAAGTTCAAAGGTCATTAAAACATGAGGATA<br>TAAATCTCCAAGAAATTATTTCTGCTGCAGGAAAAGAACTATCAGAAGCATTCAAACAAAAAACAAGTG<br>AAATTCTTTCCCATGCCCATGCTGCACTTGACCAGCCTCTTCCCACAACATTAAAAAAACAGGAAGAAA<br>AAGAAATCCTCAAATCACAGCTCGATTCGCTTTTAGGCCTTTATCATCTTCTTGATTGGTTTGCTGTCGAT<br>GAAAGCAATGAAGTCGACCCAGAATTCTCAGCACGGCTGACAGGCATTAAACTAGAAATGGAACCAAG<br>CCTTTTCGTTTTATAATAAAGCAAGAAATTATGCGACAAAAAAGCCCTATTCGGTGGAAAAATTTAAATT<br>GAATTTTCAAATGCCAACCCTTGCCTCTGTTGGGATGTCAATAAAGAAAAAAATAATGGAGCTATTTTA<br>TTCGTAAAAAATGGTCTCTATTACCTTGGTATCATGCCTAAACAGAAGGGGCGCTATAAAGCCCTGTCTT<br>TTGAGCCGACAGAAAAACATCAGAAGGATTCGATAAGATGTACTATGACTACTTCCCAGATGCCGCAA<br>AAATGATTCCTAAGTGTTCCACTCAGCTAAAGGCTGTAACCGCTCATTTTCAAACTCATACCACCCCCAT<br>TCTTCTCTCAAATAATTTCATTGAAACCTCTTGAAATCACAAAAGAAATTTATGACCTGAACAATCCTGAA<br>AAGGAGCCTAAAAAGTTTCAAACGGCTTATGCAAAGAAGACAGGCGATCAAAAAGGCTATAGAGAAGC<br>GCTTTGCAAATGGATTGACTTTACGCGGGATTTTCTCTAAATATACGAAAACAACTTCAATCGATTTA<br>TCTTCACTCCGCCCTTCTTCGCAATATAAAGATTTAGGGGAATATTACGCCGAACTGAATCCGCTTCTCT<br>ATCATATCTCCTTCCAACGAATTGCTGAAAAGGAAATCATGGATGCTGTAGAAACGGGAAAATTGTATC<br>TGTTCCAAATCTACAATAAGGATTTTGCGAAGGGCCATCACGGGGAAACCAAATCTCCACACCCTGTATT<br>GGACAGGTCTCTTCAGTCCTGAAAACCTTGCGAAAACCAGCATCAAACTTAATGGTCAAGCAGAATTGT<br>TCTATCGACCTAAAAGCCGCATGAAGCGGATGGCCCATCGTCTTGGGGAAAAAATGCTGAACAAAAAAC<br>TAAAGGACCAGAAGACACCGATTCCAGATACCCTCTACCAAGAACGTGACGATTATGTCAACCACCGGC<br>TAAGCCATGATCTTTCCGATGAAGCAAGGGCCCTGCTTCCAAATGTTATCACCAAAGAAGTCTCCCATGA<br>AATTATAAAGGATCGGCGGTTTACTTCCGATAAATTTTTCTTCCATGTTCCCATTACACTGAATTATCAAG<br>CAGCCAATAGTCCCAGTAAATTCAACCAGCGTGTCAATGCCTACCTTAAGGAGCATCCGGAAACGCCCA<br>TCATTGGTATCGATCGTGGAGAACGCAATCTAATCTATATTACCGTCATTGACAGTACTGGGAAATTTT<br>GGAGCAGCGTTCCCTGAATACCATCCAGCAATTTGACTACCAAAAAAAATTGGACAACAGGGAAAAAG<br>AGCGTGTTGCCGCCCGTCAAGCCTGGTCCGTCGTCGGAACGATCAAAGACCTTAAACAAGGCTACTTGT<br>CACAGGTCATCCATGAAATTGTAGACCTGATGATTCATTACCAAGCTGTTGTCGTCCTTGAAAACCTCAA<br>CTTCGGATTTAAATCAAAACGGACAGGCATTGCCGAAAAAGCAGTCTACCAACAATTTGAAAAGATGCT<br>AATAGATAAACTCAACTGTTTGGTTCTCAAAGATTATCCTGCTGAGAAAGTGGGAGGCGTTCTTAAACCC<br>GTATCAACTTACAGATCAGTTCACGAGCTTTGCAAAAATGGGCACGCAAAGCGGCTTCCTTTTCTATGTA<br>CCGGCCCCTTATACCTCAAAGATTGATCCCCTGACTGGTTTTGTCGATCCCTTTGTATGGAAGACCATTA<br>AAAATCATGAAAGTCGGAAGCATTTCCTAGAAGGATTTGATTTCCTGCATTATGATGTCAAAACAGGTG<br>ATTTTATCCTCCATTTTAAAATGGAATCTCTCTTTCCAGAGAGGGGCTTCCTGGCTTCATGCCAGCT<br>TGGGATATTGTTTTCGAAAAGAATGAAACCCAATTTGATGCAAAAGGGACGCCCTTCATTGCAGGAAAA<br>CGAATTGTTCCTGTAATCGAAAATCATCGTTTTACGGGTCGTTACAGAGACCTCTATCCCGCTAATGAAC<br>TCATTGCCCTTCTGGAAGAAAAGGCATTGTCTTTAGAGACGGAAGTAATATATTACCCAAACTTTTAGA<br>AAATGATGATTCTCATGCAATTGATACGATGGTCGCCTTGATTCATCCTCCAAATGAGAACGAG<br>CAATGCCGCAACGGGGAAGACTACATCAACTCTCCCGTTAGGGATCTGAACGGGGTGTGTTTCGACAG<br>TCGATTCCAAAATCCAGAATGGCCAATGGATGCGGATGCCAACGGAGCTTATCATATTGCCTTAAAAGG<br>GCAGCTTCTTCTGAACCACCTCAAAGAAAGCAAAGATCTGAAATTACAAAACGGCATCAGCAACCAAGA<br>TTGGCTGGCCTACATTCAGGAACTGAGAAACTGA |

TABLE 5-continued

| SEQ ID NO | Sequence |
|---|---|
| SEQ ID NO: 33 | ATGGCCGTCAAATCCATCAAAGTGAAACTTCGTCTCGACGATATGCCGGAGATTCGGGCCGGTCTATGG<br>AAACTTCATAAGGAAGTCAATGCGGGGGTTCGATATTACACGGAATGGCTCAGTCTTCTCCGTCAAGAG<br>AACTTGTATCGAAGAAGTCCGAATGGGGACGGAGAGCAAGAATGTGATAAGACTGCAGAAGAATGCAA<br>AGCCGAATTGTTGGAGCGGCTGCGCGCGCGTCAAGTGGAGAATGGACACCGTGGTCCGGCGGGATCGG<br>ACGATGAATTGCTGCAGTTGGCGCGTCAACTCTATGAGTTGTTGGTTCCGCAGGCGATAGGTGCGAAAG<br>GCGACGCGCAGCAAATTGCCCGCAAATTTTTGAGCCCCTTGGCCGACAAGGACGCAGTTGGTGGGCTTG<br>GAATCGCGAAGGCGGGGAACAAACCGCGGTGGGTTCGCATGCGCGAAGCGGGGGAACCAGGCTGGGAA<br>GAGGAGAAGGAGAAGGCTGAGCGCGAGGAAATCTGCGGATCGGACTGCGGATGTTTTGCGCGCGCTCGC<br>GGATTTTGGGTTAAAGCCACTGATGCGCGTATACACCGATTCTGAGATGTCATCGGTGGAGTGGAAACC<br>GCTTCGGAAGGGACAAGCCGTTCGGACGTGGGATAGGGACATGTTCCAACAAGCTATCGAACGGATGAT<br>GTCGTGGGAGTCGTGGAATCAGCGCGTTGGGAAGAGTACGCGAAACTCGTAGAACAAAAAAATCGAT<br>TTGAGCAGAAGAATTTCGTCGGCCAGGAACATCTGGTCCATCTCGTCAATCAGTTGCAACAAGATATGA<br>AAGAAGCATCGCCCGGACTCGAATCGAAAGAGCAAACCGCGCACTATGTGACGGGACGGGCATTGCGC<br>GGATCGGACAAGGTATTTGAGAAGTGGGGGAAACTCGCCCCCGATGCACCTTTCGATTTGTACGACGCC<br>GAAATCAAGATGTGCAGAGACGTAACACGAGACGATTCGGATCACATGACTTGTTCGCAAAATTGGCA<br>GAGCCAGAGTATCAGGCCCTGTGGCGCGAAGATGCTTCGTTTCTCACGCGTTACGCGGTGTACAACAGC<br>ATCCTTCGCAAACTGAATCACGCCAAAATGTTCGCGACGTTTACTTTGCCGGATGCAACGGCGCACCCG<br>ATTTGGACTCGCTTCGATAAAATTGGGTGGGAATTTGCACCAGTACACCTTTTTGTTCAACGAATTTGGAG<br>AACGCAGGCACGCGATTCGTTTTCACAAGCTATTGAAAGTCGAGAATGGTGTCGCAAGAGAAGTTGATG<br>ATGTCACCGTGCCCATTTCAATGTCAGAGCAATTGGATAATCTGCTTCCCAGAGATCCCAATGAACCGAT<br>TGCGCTATATTTTCGAGATTACGGACCGAACAGCATTTCACAGGTGAATTTGGTGGCGCGAAGATCCA<br>GTGCCGCCGGGATCAGCTGGCTCATATGCACCGACGCAGAGGGGCGAGGGATGTTTATCTCAATGTCAG<br>CGTACGTGTGCAGAGTCAGTCTGAGGCGCGGGGAGAACGTCGCCCGCCGTATGCGGCAGTATTTCGTCT<br>GGTCGGGGACAACCATCGCGCGTTTGTCCATTTCGATAAACTATCGGATTATCTTGCGGAACATCCGGAT<br>GATGGGAAGCTCGGGTCGGAGGGGTTGCTTTCCGGGCTGCGGGTGATGAGTGTCGATCTCGGCCTTCGC<br>ACATCTGCATCGATTTCCGTTTTTCGCGTTGCCCGGAAGGACGAGTTGAAGCCGAACTCAAAAGGTCGTG<br>TACCGTTTTTCTTTCCGATAAAAGGGAATGACAATCTCGTCGCGGTTCATGAGCGATCACAACTCTTGAA<br>GCTGCCTGGCGAAACGGAGTCGAAGGACCTGCGTGCTATCCGAGAAGAACGCCAACGGACATTGCGGC<br>AGTTGCGGACGCAACTGGCGTATTTGCGGCTGCTCGTCGGTGCGGTGTGGGTCGGAAGATGTGGGGCGGCGTG<br>AACGGAGTTGGGCAAAGCTTATCGAGCAGCCGGTGGATGCGGCCAATCACATGACACCGGATTGGCGC<br>GAGGCTTTTGAAAACGAACTTCAGAAGCTTAAGTCACTCCATGGTATCGTAGCGACAAGGAATGGATG<br>GATGCTGTCTACGAGAGCGTTCGCCGCGTGTGGCGTCACATGGGCAAACAGGTTCGCGATTGGCGAAAG<br>GACGTACGAAGCGGAGAGCGGCCCAAGATTCGCGGCTATGCGAAAGACGTGGTCGGTGGAAACTCGAT<br>TGAGCAAATCGAGTATCTGGAACGTCAGTACAAGTTCCTCAAGAGTTGGAGCTTCTTTGGTAAGGTGTC<br>GGGACAAGTGATTCGTGCGGAGAAGGGATCTCGTTTTGCGATCACGCTGCGCGAACACATTGATCACGC<br>GAAGGAAGATCGGCTGAAGAAATTGGCGGATCGCATCATTATGGAGGCTCTCGGCTATGTGTACGCGTT<br>GGATGAGCGCGGCAAAGGAAAGTGGGTTGCGAAGTATCCGCCGTGCCAGCTCATCCTGCTGGAGGAATT<br>GAGCGAGTACCAGTTCAATAACGACAGGCCTCCGAGCGAAAACAACCAGTTGATGCAATGGAGTCATC<br>GCGGCGTGTTCCAGGAGTTGATAAATCAGGCCCAAGTCCATGATTTACTCGTTGGGACGATGTATGCAG<br>CGTTCTCGTCGCGATTCGACGCGCGAACTGGGGCACCGGGTATCCGCTGTCGCCGGGTTCCGGCGCGTTG<br>CACCCAGGAGCACAATCCAGAACCATTTCCTTGGTGGCTGAACAAGTTTGTGGTGGAACATACGTTGGA<br>TGCTTGTCCCCTACGCGCAAGCGACCTCATCCCAACGGGTGAAGGAGAGATTTTTGTCTCGCCGTTCAGC<br>GCGGAGGAGGGGGACTTTCATCAGATTCACGCCGACCTGAATGCGGCGCAAAATCTGCAGCAGCGACTC<br>TGGTCTGATTTTGATATCAGTCAAATTCGGTTGCGGTGTGATTGGGGTGAAGTGGACGGTGAACTCGTTC<br>TGATCCCAAGGCTTACAGGAAAACGAACGGCGGATTCATATAGCAACAAGGTGTTTTATACCAATACAG<br>GTGTCACCTATTATGAGCGAGAGCGGGGGAAGAAGCGGAGAAAGGTTTTCGCGCAAGAGAAATTGTCG<br>GAGGAAGAGGCGGAGTTGCTCGTGGAAGCAGACGAGGCGAGGGAGAAATCGGTCGTTTTGATGCGTGA<br>TCCGTCTGGCATCATCAATCGGGGAAATTGGACCAGGCAAAAGGAATTTTGGTCGATGGTGAACCAGCG<br>GATCGAAGGATACTTGGTCAAGCAGATTCGCTCGCGCGTTCCATTACAAGATAGTGCGTGTGAAAACAC<br>GGGGGATATTTAA |
| SEQ ID NO: 34 | ATGGCGACACGCAGTTTTATTTTAAAAATTGAACCAAATGAAGAAGTTAAAAAGGGATTATGGAAGACG<br>CATGAGGTATTGAATCATGGAATTGCCTACTACATGAATATTCTGAAACTAATTAGACAGGAAGCTATTT<br>ATGAACATCATGAACAAGATCCTAAAAATCCGAAAAAAGTTTCAAAAGCAGAAATACAAGCCGAGTTA<br>TGGGATTTTGTTTTAAAAATGCAAAAATGTAATAGTTTTACACATGAAGTTGACAAAGATGTTGTTTTTA<br>ACATCCTGCGTGAACTATATGAAGAGTTGGTCCCTAGTTCAGTCGAGAAAAGGGTGAAGCCAATCAAT<br>TATCGAATAAGTTTCTGTACCCGCTAGTTGATCCGAACAGTCAAAGTGGGAAAGGGACGGCATCATCCG<br>GACGTAAACCTCGGTGGTATAATTTAAAAATAGCAGGCGACCCATCGTGGGAGGAAGAAAGAAAAAA<br>TGGGAAGAGGATAAAAAGAAAGATCCCCTTGCTAAAATCTTAGGTAAGTTAGCAGAATATGGGCTTATT<br>CCGCTATTTATTCCATTTACTGACAGCAACGAACCAATTGTAAAAGAAATTAAATGGATGGAAAAAAGT<br>CGTAATCAAAGTGTCCGGCGACTTGATAAGGATATGTTTATCCAAGCATTAGAGCGTTTTCTTTCATGGG<br>AAAGCTGGAACCTTAAAGTAAAGGAAGAGTATGAAAAAGTTGAAAAGGAACACAAAACACTAGAGGA<br>AAGGATAAAAGAGGACATTCAAGCATTTAAATCCCTTGAACAATATGAAAAAGAACGGCAGGAGCAAC<br>TTCTTAGAGATACATTGAATACAAATGAATACCGATTAAGCAAAAGAGGATTACGTGGTTGGCGTGAAA<br>TTATCCAAAATGGCTAAAGATGATGAAAATGAACCATCAGAAAATATTTAGAAGTATTTAAAGATT<br>ATCAACGGAAACATCCACGAGAAGCCGGGGACTATTCTGTCTATGAATTTTAAGCAAGAAAGAAAATC<br>ATTTTATTTGGCGAAATCATCCTGAATATCCTTATTTGTATGCTACATTTTGTGAAATTGACAAAAAAA<br>GAAAGACGCTAAGCAACAGGCAACTTTTACTTTGGCTGACCCGATTAACCATCCGTTATGGGTACGATTT<br>GAAGAAGAAGCGGTTCGAACTTAAACAAATATCGAATTTTAACAGAGCAATTACACACTGAAAAGTTA<br>AAAAAGAAATTAACAGTTCAACTTGATCGTTTAATTTATCCAACTGAATCCGGCGGTTGGGAGGAAAAA<br>GTAAAGTAGATATCGTTTTGTGCCGTCAAGACAATTTTATAATCAAATCTTCCTTGATATAGAAGAAA<br>AGGGGAAACATGCTTTTACTTATAAGGATGAAAGTATTAAATTCCCCCTTAAAGGTACACTTGGTGGTGC<br>AAGAGTGCAGTTTGACCGTGACCATTTGCGGAGATATCCGCATAAAGTAGAATCAGGAAATGTTGGACG<br>GATTTATTTTAACATGACAGTAAATATTGAACCAACTGAGAGCCCTGTTAGTAAGTCTTTGAAAATACAT<br>AGGGACGATTTCCCCAAGTTCGTTAATTTTAAACCGAAAGAGCTCACCGAATGGATAAAGATAGTAAA<br>GGGAAAAAATTAAAAAGTGGTATAGAATCCCTTGAAATTGGTCTACGGGTGATGAGTATCGACTTAGGT |

TABLE 5-continued

| SEQ ID NO | Sequence |
|---|---|
| | CAACGTCAAGCGGCTGCTGCATCGATTTTTGAAGTAGTTGATCAGAAACCGGATATTGAAGGGAAGTTA
TTTTTTCCAATCAAAGGAACTGAGCTTTATGCTGTTCACCGGGCAAGTTTTAACATTAAATTACCGGTG
AAACATTAGTAAAATCACGGGAAGTATTGCGGAAAGCTCGGGAGGACAACTTAAAATTAATGAATCAA
AAGTTAAACTTTCTAAGAAATGTTCTACATTTCCAACAGTTTGAAGATATCACAGAAAGAGAGAAGCGT
GTAACTAAATGGATTTCTAGACAAGAAAATAGTGATGTTCCTCTTGTATATCAAGATGAGCTAATTCAAA
TTCGTGAATTAATGTATAAACCCTATAAAGATTGGGTTGCCTTTTTAAAACAACTCCATAAACGGCTAGA
AGTCGAGATTGGCAAAGAGGTTAAGCATTGGCGAAAATCATTAAGTGACGGGAGAAAAGGTCTTTACG
GAATCTCCCTAAAAAATATTGATGAATTGATCGAACAAGGAAATTCCTTTTAAGATGGAGCTTACGTC
CAACAGAACCTGGGGAAGTAAGACGCTTGGAACCAGGACAGCGTTTTGCGATTGATCAATTAAACCACC
TAAATGCATTAAAAGAAGATCGATTAAAAAAGATGGCAAATACGATTATCATGCATGCCTTAGGTTACT
GTTATGATGTAAGAAAGAAAAAGTGGCAGGCAAAAAATCCAGCATGTCAAATTATTTTATTTGAAGATT
TATCTAACTACAATCCTTACGAGGAAAGGTCCCGTTTTGAAAACTCAAAACTGATGAAGTGGTCACGGA
GAGAAATTCCACGACAAGTCGCCTTACAAGGTGAAATTTACGGATTACAAGTTGGGGAAGTAGGTGCCC
AATTCAGTTCAAGATTCCATGCGAAAACCGGGTCGCCGGGAATTCGTTGCAGTGTTGTAACGAAAGAAA
AATTGCAGGATAATCGCTTTTTTAAAAATTTACAAAGAAGGACGACTTACTCTTGATAAATCGCAG
TTTTAAAGAAGGAGACTTATATCCAGATAAAGGTGGAGAAAAGTTTATTTCTTTATCAAAGGATCGAA
AGTTGGTAACTACGCATGCTGATATTAACGCGGCCCAAAATTTACAGAAGCGTTTTTGGACAAGAACAC
ATGGATTTTATAAAGTTTACTGCAAAGCCTATCAGGTTGATGACAAACTGTTTATATTCCGGAGAGCAA
GGACCAAAACAAAAATAATTGAAGAATTTGGGGAAGGCTATTTTATTTTAAAAGATGGTGTATATGA
ATGGGGTAATGCGGGGAAACTAAAAATTAAAAAAGGTTCCTCTAAACAATCATCGAGTGAATTAGTAGA
TTCGGACATACTGAAAGATTCATTTGATTTAGCAAGTGAACTTAAGGGAGAGAAACTCATGTTATATCG
AGATCCGAGTGGAAACGTATTTCCTTCCGACAAGTGGATGGCAGCAGGAGTATTTTTTGGCAAATTAGA
AAGAATATTGATTTCTAAGTTAACAAATCAATACTCAATATCAACAATAGAAGATGATTCTTCAAAACA
ATCAATGTAA |
| SEQ ID NO: 35 | ATGCCCACCCGCACCATCAATCTGAAACTTGTTCTTGGGAAAAATCCTGAAAACGCAACATTGCGACGC
GCCCTATTTTCGACACACCGTTTGGTTAACCAAGCGACGAAACGTATTGAGGAATTCTTGTTGCTGTGTC
GTGGAGAAGCCTACAGAACAGTGGATAATGAGGGGAAGGAAGCCGAGATTCCACGTCATGCAGTCCAA
GAAGAAGCTCTTGCCTTTGCCAAAGCTGCTCAACGCCACAACGGCTGTATATCCACCTATGAAGACCAA
GAGATTCTTGATGTACTGCGGCAACTGTACGAACGTCTTGTTCCTTCGGTCAACGAAAACAACGAGGCA
GGCGATGCTCAAGCTGCTAACGCCTGGGTCAGTCCGCTCATGTCGGCAGAAAGCGAAGGAGGCTTGTCG
GTCTACGACAAGGTGCTTGATCCACCGCCGGTTTGGATGAAGCTTAAAGAAGAAAAGGCTCCAGGATGG
GAAGCCGCTTCTCAAATTTGGATTCAGAGTGATGAGGGACAGTCGTTACTTAATAAGCCAGGTAGCCCT
CCCCGCTGGATTCGAAAACTGCGATCTGGGCAACCGTGGCAAGATGATTTCGTCAGTGACCAAAAGAAA
AAGCAAGATGAGCTGACCAAAGGGAACGCACCACTTATAAAACAACTCAAAGAAATGGGGTTGTTGCC
TCTTGTTAACCCATTTTTTAGACATCTTCTTGACCCTGAAGGTAAAGGCGTGAGTCCATGGGACCGTCTT
GCTGTACGCGCTGCAGTGGCTCACTTTATCTCCTGGGAAAGTTGGAATCATAGAACACGTGCAGAATAC
AATTCCTTGAAACTACGGCGAGACGAGTTTGAGGCAGCATCCGAAGCAGATTTCAAAGACGATTTTACTTTG
CTCCGACAATATGAAGCCAAACGCCATAGTACATTGAAAAGCATCGCGCTGGCCGACGATTCGAACCCT
TACCGGATTGGAGTACGTTCTCTGCGTGCCTGGAACCGCGTTCGTGAAGAATGGATAGACAAGGGTGCA
ACAGAAGAACAACGCGTGACCATATTGTCAAAGCTTCAAACACAACTTCGGGGAAAATTCGGCGATCCC
GATCTGTTCAACTGGCTAGCTCAGGATAGGCATGTCCATTTGTGGTCTCCTCGGGACACCATCACCAT
TGGTTCGCATCAATGCGGTAGATAAAGTTCTGCGTCGACGAAAACCGTATGCATTGATGACCTTTGCCCA
TCCCCGCTTCCACCCTCGATGGATACTGTACGAGGCTCCAGGAGGAAGCAATCTCCGTCAATATGCATTG
GATTGTACAGAAAACGCTCTACACATCACGTTGCCTTTGCTTGTCGACGATGCGCACGGAACCTGGATTG
AAAAAAGATCAGGGTGCCGCTGGCACCATCCGGACAAATTCAAAGATTTAACTCTGGAAAAACTTGAGA
AGAAAAAAAATCGTTTATACTACCGTTCCGGTTTTCAGCAGTTTGCCGGCTTGGCTGGCGGAGCTGAGGT
TCTTTTCCACAGACCCTATATGGAACACGACGAACGCAGCGAGGAGTCTCTTTTGGAACGTCCGGGAGC
CGTTTGGTTCAAATTGACCCTGGATGTGGCAACACAGGCTCCCCCGAACTGGCTTGATGGTAAGGGCCG
TGTCCGTACACCGCCGGAGGTACATCATTTTAAAACCGCATTGTCGAATAAAAGCAAACATACACGTAT
GCTGCAGCCGGGTCTCCGTGTCTTGTCAGTAGACTTGGGCATGCGAACATTCGCCTCCTGCTCAGTATTT
GAACTCATCGAGGGAAAGCCTGAGACAGGCCGTGCCTTCCCTGTTGCCGATGAGAGATCAATGGACAGC
CCGAATAAACTGTGGGCCAAGCATGAACGTAGTTTTAAACTGACGCTCCCCGGCGAAACCCCTTCTCGA
AAGGAAGAGGAAGAGCGTAGCATAGCAAGAGGGAAATTTATGCACTGAAAGCGCGACATACAACGCCT
CAAAAGCCTACTCCGCTTAGGTGAAGAAGATAACGATAACCGTCGTGATGCATTGCTTGAACAGTTCTTT
AAAGGATGGGAGAAGAAGACGTTGTGCCTGGACAAGCGTTTCCACGCTCTCTTTTCCAAGGGTTGGGA
GCTGCCCCGTTTCGCTCAACTCCAGAGTTATGGCGTCAGCATTGCCAAACATATTATGACAAAGCGGAA
GCCTGTCTGGCTAAACATATCAGTGATTGGCGCAAGCGAACTCGTCCCCGTCCGACATCGCGGGAGATG
TGGTACAAAACACGTTCCTATCATGGCGGCAAGTCCATTTGGATGTTGGAATATCTTGATGCCGTTCGAA
AACTGCTTCTCAGTTGGAGCTTACGTGGTCGTACTTACGGTGCCATTAATCGCCAGGATACAGCCCGGTT
TGGTTCTTTGGCATCACGGCTGCTCCACCATATCAATTCCCTAAAGGAAGACCGCATCAAAACAGGAGC
CGACTCTATCGTTCAGGCTGCTCGCGGGTATATTCCTCTCCCTCATGGCAAGGGTTGGGAACAAAGATAT
GAGCCTTGTCAGCTCATATTATTTGAAGACTCGCACGATATCTGCTGTCGCGAG
AGAACAGCCAACTCATGCAGTGGAACCATCGAGCCATCGTGGCAGAAACAACGATGCAAGCCGAACTC
TACGGACAAATTGTCGAAAATACTGCAGCGGGGTTCAGCAGTCGTTTTCACGCGGCGACAGGTGCCCCC
GGTGTACGTTGTCGTTTCTTCTAGAAAGAGACTTTGATAACGATTTGCCCAAACCGTACCTTCTCAGGG
AACTTTCTTGGATGCTCGGCAATACAAAAGTCGAGTCTGAAGAAGAAAAGCTTCGATTGCTGTCTGAAA
AAATCAGGCCAGGCAGTCTTGTTCCTTGGGATGGAGGCGAACAGTTCGCTACCCTGCATCCCAAAAGAC
AAACACTTTGCGTCATTCATGCCGATATGAATGCTGCCAAAATTTACAACGCCGGTTTTTCGGTCGATG
CGGCGAGGCCTTTCGGCTTGTTTGTCAACCCCACGGTGACGACGTGTTACGACTCGCATCCACCCCAGGA
GCTCGTCTTCTTGGAGCCCTGCAGCAGCTTGAAAATGCAAGGAGCTTTCGAGTTGGTTCGAGACATG
GGGTCAACAAGTCAAATGAACCGGTTCGTCATGAAGTCTTTGGGAAAAAGAAAATAAAACCCCTTCAG
GACAACAATGGAGACGACGAGCTTGAAGACGTGTTGTCCGTACTCCCGGAGGAAGACGACACAGGACG
TATCACAGTCTTCCGCGATTCATCAGGAATCTTTTTTCCTTGCAACGTCTGGATACCGGCCAAACAGTTTT
GGCCAGCAGTACGCGCCATGATTTGGAAGGTCATGGCTTCCCATTCTTTGGGGTGA |

TABLE 5-continued

| SEQ ID NO | Sequence |
|---|---|
| SEQ ID NO: 36 | ATGACAAAGTTAAGACACCGACAGAAAAAATTAACACACGACTGGGCTGGCTCCAAAAAGAGGGAAGT ATTAGGCTCAAATGGCAAGCTTCAGAATCCGTTGTTAATGCCGGTTAAAAAAGGTCAGGTTACTGAGTT CCGGAAAGCGTTTTCTGCGTATGCTCGCGCAACGAAAGGAGAAATGACTGACGGCCGAAAGAATATGTT TACGCATAGTTTCGAGCCATTTAAGACAAAGCCCTCGCTTCATCAGTGTGAATTGGCAGATAAAGCATAT CAATCTTTACATTCGTATCTGCCTGGTTCTCTTGCTCATTTTCTATTATCTGCTCACGCATTAGGTTTTCGT ATTTTTTCAAAATCTGGTGAAGCAACTGCATTCCAGGCATCCTCTAAAATTGAAGCTTACGAATCAAAAT TGGCAAGCGAATTAGCTTGTGTAGATTTATCTATTCAAAACTTGACTATTTCAACGCTTTTTAATGCGCTT ACAACGTCTGTAAGAGGGAAGGGCGAAGAAACTAGCGCTGACCCCTTAATTGCACGATTTTACACCTTA CTTACTGGCAAGCCTCTGTCTCGAGACACTCAAGGGCCTGAACGTGATTTAGCAGAAGTTATCTCGCGTA AGATAGCTAGTTCTTTTGGCACATGGAAAGAAATGACGGCAAACCCTCTTCAGTCATTACAATTTTTTGA AGAGGAACTCCATGCGCTGGATGCCAATGTCTCGCTCTCACCCGCCTTCGACGTTTTAATTAAAATGAAT GATTTGCAGGGCGATTTAAAAAATCGAACCATTGTTTTTGATCCTGACGCCCCTGTTTTTGAATATAACG CAGAAGACCCTGCCGACATAATTATTAAACTTACAGCTCGTTACGCTAAAGAAGCTGTCATCAAAAATC AAAACGTAGGAAATTACGTTAAAAACGCTATTACTACCACAAATGCCAATGGTCTTGGTTGGCTTTTGA ACAAAGGTTTGTCGTTACTCCCTGTCTCGACCGATGACGAATTGCTAGAGTTTATTGGCGTTAACGATC TCATCCCTCATGCCATGCCTTAATTGAATTGATTGCACAATTAGAAGCCCCCGAGCTCTTTGAGAAGAAC GTATTTTCAGATACTCGTTCTGAAGTTCAAGGTATGATTGCTGCATCAGCTGTTTCTAATCATATTGCTCGTCT TTCCAGCTCTAGAAATAGCTTGTCAATGGATAGTGAAGAATTAGAACGTTTAATCAAAAGCTTTCAGAT ACACACACCTCATTGCTCACTTTTTATTGGCGCCCAATCACTTTCACAGCAGTTAGAATCTTTGCCTGAA GCCCTTCAATCGGGCGTTAATTCAGCCGATATTTTACTAGGCTCTACTCAATATATGCTCACCAATTCTTT GGTTGAAGAGTCAATTGCAACTTATCAAAGAACACTTAATCGCATCAATTACTTGTCAGGTGTTGCAGGT CAGATTAACGGCGCAATAAAGCGAAAAGCGATAGATGGAGAAAAAATTCACTTGCCTGCAGCTTGGTC AGAGTTGATATCTTTACCATTTATAGGCCAGCCTGTTATAGATGTTGAAAGCGATTTAGCTCATCTAAAA AATCAATACCAAACACTTTCAAATGAGTTTGATACTCTTATATCTGCTTTGCAAAAGAATTTTGATTTGA ACTTTAATAAAGCGCTCCTTAATCGTACTCAGCATTTTGAAGCCATGTGTAGAAGCACTAAGAAAAACG CTTTATCCAAACCAGAGATCGTTTCCTATCGCGACCTGCTTGCTCGATTAACTTCTTGTTTGTATCGAGGC TCTTTAGTTTTGCGTCGTGCCGGCATTGAAGTGTTAAAAAAACATAAAATATTTGAGTCAAACAGCGAAC TTCGTGAACATGTTCATGAAAGAAAGCATTTCGTGTTTGTTAGTCCTCTAGATCGCAAAGCCAAGAAACT CCTTCGATTAACTGATTCGCGTCCAGACTTGTTACATGTTAGTGAAATATTGCAGCACGATAATCTT GAAAACAAAGACCGCGAGTCACTTTGGCTAGTTCGCTCTGGTTATTTGCTTGCAGGACTTCCAGATCAAC TTTCTTCATCTTTTATTAACTTGCCTATCATTACTCAAAAGGAGATAGACGCCTTATAGACCTGATTCAG TATGATCAAATTAATCGTGATGCTTTTGTTATGTTAGTGACCTCTGCATTCAAGTCTAATTTGTCTGGTCT GCAGTATCGTGCCAATAAGCAATCGTTCGTTGTTACTCGCACGCTAAGCCCTTATCTCGGCTCAAAACTT GTCTACGTACCCAAGGATAAAGATTGGTTAGTTCCTTCTCAAATGTTTGAAGGACGATTTGCTGACATTC TTCAATCAGATTATATGGTCTGGAAAGATGCCGGTCGTCTTTGTGTTATTGATACTGCAAAACACCTTTC TAATATAAAGAAGTCTGTATTTTCATCCGAAGAAGTTCTCGCTTTTTTAAGAGAACTCCCTCACCGCACA TTTATCCAGACCGAAGTTCGCGGCCTTGGCGTTAATGTCGATGAATTGCATTTAATAATGGTGATATTC CGTCATTAAAAACCTTTTCAAATTGCGTTCAGGTAAAAGTTTCTGACTAATACATCCCTAGTTCAAAC ACTTAATCGTTGGTTTGAAGGAGGAAAAGTTTCTCCTCCGAGCATTCAATTTGAACGGGCGTATTATAAA AAAGACGATCAAATTCATGAAGACGCAGCGAAAAGAAAGATACGATTCCAGATGCCCGCAACTGAGTT GGTTCATGCTTCTGACGATGCGGGGTGGACACCAAGTTATTTGCTCGGCATTGATCCTGGCGAGTATGGA ATGGGTCTTTCATTGGTTTGCATATTAATAACGGAGAAGTCTTAGATTCAGGCTTTATTCATATTAATTCTCT GATCAATTTTGCCTCTAAAAAGAGCAACCATCAAACTAAGGTTGTTCCGCGTCAGCAGTACAAATCTCCT TATGCAAATTATTTAGAACAATCTAAAGATTCTGCTGCTGGTGATATTGCGCATATACTCGATCGACTTA TATACAAATTAAATGCGTTGCCTGTTTTTGAGGCTCTTCAGGTAATTCTCAGAGTGCTGCTGATCAAGTT TGGACGAAAGTCTTATCGTTTTACACTTGGGGTGATAATGACGCTCAGAATTCTATTAGAAAGCAGCATT GGTTTGGAGCCAGTCATTGGGATATCAAAGGTATGTTAAGGCAACCCCCTACGGAGAAGAAGCCTAAAC CGTATATTGCTTTTCCTGGCTCTCAGGTTTCTTCGTATGGTAATTCCCAACGTTGCTCTTGCTGCGGTCGC AATCCTATTGAACAACTTCGAGAAATGGCAAAGGATACCTCTATTAAAGAGCTAAAAATTCGCAATTCT GAGATACAGCTTTTTGACGGAACCATTAAATTATTTAATCCAGACCATCCACTGTGATAGAGAGAAGG CGACATAATCTTGGTCCATCAAGAATTCCTGTTGCTGACCGTACTTTCAAAAACATCAGTCCATCAAGTC TAGAATTTAAAGAATTGATTACTATCGTGTCTCGATCTATCCGTCATTCACCTGAGTTTATCGCTAAAAA ACGCGGCATAGGGTCTGAGTATTTTGCGCTTATTCCGATTGCAACTCATCCTTAAATTCTGAAGCTAAC GCAGCTGCTAACGTAGCGCAAAAATTTCAAAAACAGTTATTTTTGAGTTATAA |
| SEQ ID NO: 37 | ATGAAGAGAATTCTGAACAGTCTGAAAGTTGCTGCCTTGAGACTTCGTTTCGAGGCAAAGGTTCTGAAT TAGTGAAGACAGTCAAATATCCATTGGTTTCCCCGGTTCAAGGCGCGGTTGAAGAACTTGCTGAAGCAA TTCGGCACGACAACCTGCACCTTTTTGGGCAGAAGGAAATAGTGGATCTTATGGAGAAAGACGAAGGAA CCCAGGTGTATTCGGTTGTGGATTTTGGTTGGATACCCTGCGTTTAGGGATGTTTTTCTCACCATCAGCG AATGCGTTGAAAATCACGCTGGGAAAATTCAATTCTGATCAGGTTTCACCTTTTCGTAAGGTTTTGGAGC AGTCACCTTTTTTTTCTTGCGGGTCGCTTGAAGGTTGAACCTGCGGAAAGGATACTTTCTGTTGAAATCAG AAAGATTGGTAAAAGAGAAAACAGAGTTGAGAACTATGCCGCCGATGTGGAGACATGCTTCATTGGTCA GCTTTCTTCAGATGAGAAACAGAGTATCCAGAAGCTGGCAAATGATATCTGGGATAGCAAGGATCATGA GGAACAGAGAATGTTGAAGGCGGATTTTTTGCTATACCTCTTATAAAAGACCCCAAAGCTGTCACAGA AGAAGATCCTGAAAATGAAACGGCGGGAAAACAGAAACCGCTTGAATTATGTGTTTGTCTTGTTCCTGA GTTGTATACCCGAGGTTTCGGCTCCATTGCTGATTTTCTGGTTCAGCGACTTACCTTGCTGCGTGACAAA ATGAGTACCGACACGGCGAAGATTGCCTCGAGTATGTTGGCATTGAGGAAGAAAAAGGCAATGGAAT GAATTCCTTGCTCGGCACTTTTTTGAAGAACCTGCAGGGTGATGGTTTTGAACAGATTTTTCAGTTTATGC TTGGGTCTTATGTTGGCTGGCAGGGGAAGGAAGATGTACTGCGCGAACGATTGGATTTGCTGGCCGAAA AAGTCAAAAGATTACCAAAGCCAAAATTTGCCGGAGAATGGAGTGGTCATCGTATGTTTCTCCATGGTC AGCTGAAAAGCTGGTCGTCGAATTTCTTCCGTCTTTTAATGAAGGAACTTCTGAAAGTATCAA GAGTGATATTCAACATGCCACCATGCTCATTAGCTATGGAAGAGAAAGGAGGCTATCATCCACAGCT GTTGAGTCAGTATCGGAAGTTAATGGAACAATTACCGGCGTTGCGGACTAAGGTTTTGGATCCTGAGAT TGAGATGACGCATATGTCCGAGGCTGTTCGAAGTTACATTATGATACAAGTCTGTAGCGGGATTTCTG CCGGATTTACTCGAGTCTTTTGGATCGAGATAAGGATAGGGAATTTTTGCTTTCCATCTTTCCTCGTATTCC AAAGATAGATAAGAAGACGAAAGAGATCGTTGCATGGGAGCTACCGGGCGAGCCAGAGGAAGGCTATT |

TABLE 5-continued

| SEQ ID NO | Sequence |
|---|---|
| | TGTTCACAGCAAACAACCTTTTCCGGAATTTTCTTGAGAATCCGAAACATGTGCCACGATTTATGGCAGA GAGGATTCCCGAGGATTGGACGCGTTTGCGCTCGGCCCCTGTGTGGTTTGATGGGATGGTGAAGCAATG GCAGAAGGTGGTGAATCAGTTGGTTGAATCTCCAGGCGCCCTTTATCAGTTCAATGAAAGTTTTTTGCGT CAAAGACTGCAAGCAATGCTTACGGTCTATAAGCGGGATCTCCAGACTGAGAAGTTTCTGAAGCTGCTG GCTGATGTCTGTCGTCCACTCGTTGATTTTTTCGGACTTGGAGGAAATGATATTATCTTCAAGTCATGTCA GGATCCAAGAAAGCAATGGCAGACTGTTATTCCACTCAGTGTCCCAGCGGATGTTTATACAGCATGTGA AGGCTTGGCTATTCGTCTCCGCGAAACTCTTGGATTCGAATGGAAAATCTGAAAGGACACGAGCGGGA AGATTTTTTACGGCTGCATCAGTTGCTGGGAAATCTGCTGTTCTGGATCAGGGATGCGAAACTTGTCGTG AAGCTGGAAGACTGGATGAACAATCCTTGTGTTCAGGAGTATGTGGAAGCACGAAAAGCCATTGATCTT CCCTTGGAGATTTTCGGATTTGAGGTGCCGATTTTTCTCAATGGCTATCTCTTTTCGGAACTGCGCCAGCT GGAATTGTTGCTGAGGCGTAAGTCGGTGATGACGTCTTACAGCGTCAAAACGACAGGCTCGCCAAATAG GCTCTTCCAGTTGGTTTACCTACCTCTAAACCCTTCAGATCCGGAAAAGAAAAATTCCAACAACTTTCAG GAGCGCCTCGATACACCTACCGGTTTGTCGCGTCGTTTTCTGAATCATCGCTGGATGCATTTGCTGGCA AACTCTTGACGGATCCGGTAACTCAGGAACTGAAGACGATGGCCGGTTTTTACGATCATCTCTTTGGCTT CAAGTTGCCGTGTAAACTGGCGGCGATGAGTAACCATCCAGGATCCTCTTCCAAATGGTGGTTCTGGC AAAACCAAAGAAGGGTGTTGCTAGTAACATCGGCTTTGAACCTATTCCCGATCCTGCTCATCCTGTGTTC CGGGTGAGAAGTTCCTGGCCGGAGTTGAAGTACCTGGAGGGGTTGTTGTATCTTCCCGAAGATACACCA CTGACCATTGAACTGGCGGAAACGTCGGTCAGTTGTCAGTCTGTGAGTTCAGTCGCTTTCGATTTGAAGA ATCTGACGACTATCTTGGGTCGTGTTGGTGAATTCAGGGTGACGGCAGATCAACCTTTCAAGCTGACGCC CATTATTCCTGAGAAAGAGGAATCCTTCATCGGGAAGACCTACCTCGGTCTTGATGCTGGAGAGCGATC TGGCGTTGGTTTCGCGATTGTGACGGTTGACGGCGATGGGTATGAGGTGCAGAGGTTGGGTGTGCATGA AGATACTCAGCTTATGGCGCTTCAGCAAGTCGCCAGCAAGTCTCTTAAGGAGCCGGTTTTCCAGCCACTC CGTAAGGGCACATTTCGTCAGCAGGAGCGCATTCGCAAAAGCCTCCGCGGTTGCTACTGGAATTTCTATC ATGCATTGATGATCAAGTACCGAGCTAAAGTTGTGCATGAGGAATCGGTGGGTTCATCCGGTCTGGTGG GGCAGTGGCTGCGTGCATTTCAGAAGGATCTCAAAAAGGCTGATGTTCTGCCCAAGAAGGGTGGAAAAA ATGGTGTAGACAAAAAAAAGAGAGAAAGCAGCGCTCAGGATACCTTATGGGGAGGAGCTTTCTCGAAG AAGGAAGAGCAGCAGATAGCCTTTGAGGTTCAGGCAGCTGGATCAAGCCAGTTTTTGTCTGAAGTGTGGT TGGTGGTTTCAGTTGGGGATGCGGGAAGTAAATCGTGTGCAGGAGAGTGGCGTGGTGCTGGACTGGAAC CGGTCCATTGTAACCTTCCTCATCGAATCCTCAGGAGAAAAGGTATATGGTTTCAGTCCTCAGCAACTGG AAAAAGGCTTTCGTCCTGACATCGAAACGTTCAAAAAAATGGTAAGGGATTTTATGAGACCCCCCATGT TTGATCGCAAAGGTCGGCCGGCCGCGGCGTATGAAAGATTCGTACTGGGACGTCGTCACCGTCGTTATC GCTTTGATAAAGTTTTTGAAGAGAGATTTGGTCGCAGTGCTCTTTTCATCTGCCCGCGGGTCGGGTGTGG GAATTTCGATCACTCCAGTGAGCAGTCAGCCGTTGTCCTTGCCCTTATTGGTTACATTGCTGATAAGGAA GGGATGAGTGGTAAGAAGCTTGTTTATGTGAGGCTGGCTGAACTTATGGCTGAGTGGAAGCTGAAGAAA CTGGAGAGATCAAGGGTGGAAGAACAGAGCTCGGCACAATAA |
| SEQ ID NO: 38 | ATGGCAGAAAGCAAGCAGATGCAATGCCGCAAGTGCGGCGCAAGCATGAAGTATGAAGTAATTGGATT GGGCAAGAAGTCATGCAGATATATGTGCCCAGATTGCGGCAATCACACCAGCGCGCAAGATTCAGA ACAAGAAAAAGCGCGACAAAAAGTATGGATCCGCAAGCAAAGCGCAGAGCCAGAGGATAGCTGTGGCT GGCGCGCTTTATCCAGACAAAAAAGTGCAGACCATAAAGACCTACAAATACCCAGCGGATCTTAATGGC GAAGTTCATGACAGCGGCGTCGCAGAGAAGATTGCGCAGGCGATTCAGGAAGATGAGATCGGCCTGCTT GGCCCGTCCAGCGAATACGCTTGCTGGATTGCTTCACAAAAACAGAGCGAGCGCGATATTCAGTTGTAGAT TTTTGGTTTGACGCGGTGTGCGCAGGCGGAGTATTCGCGTATTCTGGCGCGCGCCTGCTTTCCACAGTCC TCCAGTTGAGTGGCGAGGAAAGCGTTTTGCGCGCTGCTTTAGCATCTAGCCCGTTTGTAGATGACATTAA TTTGGCGCAAGCGGAAAAGTTCCTAGCCGTTAGCCGGCGCACAGGCCAAGATAAGCTAGGCAAGCGCAT TGGAGAATGTTTTGCGGAAGGCCGGCTTGAAGCGCTTGGCATCAAAGATCGCATGCGCGAATTCGTGCA AGCGATTGATGTGGCCCAAACCGCGGGCCAGCGGTTCGCGGCCAAGCTAAAGATATTCGGCATCAGTCA GATGCCTGAAGCCAAGCAATGGAACAATGATTCCGGCTCACTGTATGTATTTTGCCGGATTATTATGTC CCGGAAGAAAACCGCGCGGACCAGCTGGTTGTTTTGCTTCGGCGCTTACGCGAGATCGCGTATTGCATG GGAATTGAGGATGAAGCAGGATTTGAGCATCTAGGCATTGACCCTGGTGCTCTTTCCAATTTTTCCAATG GCAATCCAAAGCGAGGATTTCTCGGCCGCCTGCTCAATAATGACATTATAGCGCTGGCAAACAACATGT CAGCCATGACGCCGTATTGGGAAGGCAGAAAGGCGAGTTGATTGAGCGCCTTGCATGGCTTAAACATC GCGCTGAAGGATTGTATTTGAAAGAGCCACATTTCGGCAACTCCTGGGCAGACCACCGCAGCAGGATTT TCAGTCGCATTGCGGGCTGGCTTTTCCGGATGCGCGGGCAAGCTCAAGATTGCCAAGGATCAGATTTCAG GCGTGCGTACGGATTTGTTTCTGCTCAAGCGCCTTCTGGATGCGGTACCGCAAAGCGCGCCGTCGCCGGA CTTTATTGCTTCCATCAGCGCGCTGGATCGGTTTTTGGAAGCGGCAGAAAGCAGCCAGGATCCGGCAGA ACAGGTACGCGCTTTGTACGCGTTTCATCTGAACGCGCCTGCGGTCCGATCCATCGCCAACAAGGCGGT ACAGAGGTCTGATTCCCAGGAGTGGCTTATCAAGGAACTGGATGGCTGTAGATCACCTTGAATTCAACAA AGCATTTCCGTTTTTTCGGATACAGGAAAGAAAAAGAAGAAAGGGCGAATACGAACGGAGCGCCTTC TGAAGAAGAATACACGGAAACAGAATCCATTCAACAACCAGAAGATGCAGAGCAGGAAGTGAATGGTC AAGAAGGAAATGGCGCTTCAAAGAACCAGAAAAAGTTTCAGCGCATTCCTCGATTTTTCGGGGAAGGGT CAAGGAGTGAGTATCGAATTTTAACAGAAGCGCCGCAATATTTTGACATGTTCTGCAATAATATGCGCG GATCTTTATGCAGCTAGAGAGTCAGCCGCGCAAGGCGCCTCGTGAATCGAATGCTTTCTGCAGAATCG TTTGCAGAAGCTTTACAAGCAAACCTTTCTCAATGCTCGCAGTAATAAATGCCGCGCGCTTCTGGAATCC GTCCTTATTTCATGGGAGAATTTTATACTTATGGCGCGAATGAAAAGAAGTTTCGTCTGCGCGCCATGAAG CGAGCGAGCGCAGCTCGGATCCGGACTATGTGGTTCAGCAGGCATTGGAAATCGCGCGCCGGCTTTTCT TGTTCGGATTTGAGTGGCGCAGTGCTGCTGCTGAGAGCGCGTTGGATTTGGTTGAAATCCACAAAAAAG CAATCTCATTTTTGCTTGCAATCACTCAGGCCGAGGTTTCAGTTGGTTCCTATAACTGGCTTGGGAATAG CACCGTGAGCCGGTATCTTTCGGTTGCTGGCACAGACACATTGTACGGCACTCAACTGGAGGAGTTTTTG AACGCCACAGTGCTTTCACAGATGCGTGGGCTGGCGATTCGGCTTTCATCTCAGGAGTTAAAAGACGGA TTTGATGTTCAGTTGGAGAGTTCGCAGGACAATCTCCAGGCCGCAATGCTCGTGTGATCGCGCTTCGCGCG ACTTGGCTGCGTGCAAACGCGCTACATGCCCGGCTGAATTGGATCCGAAAATTCTTGTTCTGCCGGTTGG TGCGTTTATCGCGAGCGTAATGAAATGATTGAGCGTGGCGATGAACCATTAGCAGGCGCGTATTTGCG TCATCGGCCGCATTCATTCGGCTGGCAGATACGGGTTCGTGGAGTGGCGGAAGTAGGCATGGATCAGGG CACAGCGCTAGCATTCAGAAGCCGACTGAATCAGAGCCGTTTAAAATAAAGCCGTTTTCCGCTCAATA CGGCCCAGTACTTTGGCTTAATTCTTCATCCTATAGCCAGAGCCAGTATCTGGATGGATTTTAAGCCAG |

TABLE 5-continued

| SEQ ID NO | Sequence |
|---|---|
| | CCAAAGAATTGGTCTATGCGGGTGCTACCTCAAGCCGGATCAGTGCGCGTGGAACAGCGCGTTGCTCTG<br>ATATGGAATTTGCAGGCAGGCAAGATGCGGCTGGAGCGCTCTGGAGCGCGCGCGTTTTTCATGCCAGTG<br>CCATTCAGCTTCAGGCCGTCTGGTTCAGGAGATGAAGCAGTATTGGCGCCGAATCGGTACTTGGGACTTT<br>TTCCGCATTCCGGAGGAATAGAATACGCGGTGGTGGATGTATTAGATTCCGCGGGTTTCAAAATTCTTGA<br>GCGCGGTACGATTGCGGTAAATGGCTTTTCCCAGAAGCGCGGCGAACGCCAAGAGGAGGCACACAGAG<br>AAAAACAGAGACGCGGAATTTCTGATATAGGCCGCAAGAAGCCGGTGCAAGCTGAAGTTGACGCAGCC<br>AATGAATTGCACCGCAAATACACCGATGTTGCCACTCGTTTAGGGTGCAGAATTGTGGTTCAGTGGGCG<br>CCCCAGCCAAAGCCGGGCACAGCGCCGACCGCGCAAACAGTATACGGCGCGCAGTGCGGACCGAAGC<br>GCCGCGATCTGGAAATCAAGAGGATCATGCTCGTATGAAATCCTCTTGGGGATATACCTGGGGCACCTA<br>TTGGGAGAAGCGCAAACCAGAGGATATTTGGGCATCTCAACCCAAGTATACTGGACCGGCGGTATAGG<br>CGAGTCATGTCCCGCAGTCGCGGTTGCGCTTTTGGGGCACATTAGGGCAACATCCACTCAAACTGAATG<br>GGAAAAAGAGGAGGTTGTATTCGGTCGACTGAAGAAGTTCTTTCCAAGCTAG |
| SEQ ID NO: 39 | ATGGAAAAGAGAATAAACAAGATACGAAAGAAACTATCGGCCGATAATGCCACAAAGCCTGTGAGCAG<br>GAGCGGCCCCATGAAAACACTCCTTGTCCGGGTCATGACGGACGACTTGAAAAAAGACTGGAGAAGC<br>GTCGGAAAAAGCCGGAAGTTATGCCGCAGGTTATTTCAAATAACGCAGCAAACAATCTTAGAATGCTCC<br>TTGATGACTATACAAAGATGAAGGAGGCGATACTACAAGTTTACTGGCAGGAATTTAAGGACGACCATG<br>TGGGCTTGATGTGCAAATTTGCCCAGCCTGCTTCCAAAAAAATTGACCAGAACAAACTAAAACCGGAAA<br>TGGATGAAAAAGGAAATCTAACAACTGCCGGTTTTGCATGTTCTCAATGCGGTCAGCCGCTATTTGTTTA<br>TAAGCTTGAACAGGTGAGTGAAAAAGGCAAGGCTTATACAAATTACTTCGGCCGGTGTAATGTGGCCGA<br>GCATGAGAAATTGATTCTTCTTGCTCAATTAAAACCTGAAAAAGACAGTGACGAAGCAGTGACATACTC<br>CCTTGGCAAATTCGGCCAGAGGGCATTGGACTTTTATTCAATCCACGTAACAAAAGAATCCACCCATCC<br>AGTAAAGCCCCTGGCACAGATTGCGGGCAACCGCTATGCAAGCGGACCTGTTGGCAAGGCCCTTTCCGA<br>TGCCTGTATGGGCACTATAGCCAGTTTTCTTCGAAATATCAAGACATCATCATAGAACATCAAAAGGTT<br>GTGAAGGGTAATCAAAAGAGGTTAGAGAGTCTCAGGGAATTGGCAGGGAAAGAAAATCTTGAGTACCC<br>ATCGGTTACACTGCCGCCGCAGCCGCATACGAAAGAAGGGGTTGACGCTTATAACGAAGTTATTGCAAG<br>GGTACGTATGTGGGTTAATCTTAATCTGTGGCAAAAGCTGAAGCTCAGCCGTGATGACGCAAAACCGCT<br>ACTGCGGCTAAAAGGATTCCCATCTTTCCCTGTTGTGGAGCGGCGTGAAAACGAAGTTGACTGGTGGAA<br>TACGATTAATGAAGTAAAAAAACTGATTGACGCTAAACGAGATATGGACGGGTATTCTGGAGCGGCGT<br>TACCGCAGAAAAGAGAAATACCATCCTTGAAGGATACAACTATCTGCCAAATGAGAATGACCATAAAA<br>AGAGAGAGGGCAGTTTGGAAAACCCTAAGAAGCCTGCCAAACGCCAGTTTGGAGACCTCTTGCTGTATC<br>TTGAAAAGAAATATGCCGGAGACTGGGGAAAGGTCTTCGATGAGGCATGGGAGAGGATAGATAAGAAA<br>ATAGCCGGACTCACAAGCCATATAGAGCGCGAAGAAGCAAGAAACGCGGAAGACGCTCAATCCAAAGC<br>CGTACTTACAGACTGGCTAAGGGCAAAGGCATCATTTGTTCTTGAAAGACTGAAGGAAATGGATGAAAA<br>GGAATTCTATGCGTGTGAAATCCAACTTCAAAAATGGTATGGCGATCTTCGAGGCAACCCGTTTGCCGTT<br>GAAGCTGAGAATAGAGTTGTTGATATAAGCGGGTTTTCTATCGGAAGCGATGGCCATTCAATCCAATAC<br>AGAAATCTCCTTGCCTGGAAATATCTGGAGAACGGCAAGCGTGAATTCTATCTGTTAATGAATTATGGC<br>AAGAAAGGCGCATCAGATTTACAGATGGAACAGATATTAAAAAGAGCGGCAAATGGCAGGGACTATT<br>ATATGGCGGTGGCAAGGCAAAGGTTATTGATCTGACTTTCGACCCCGATGATGAACAGTTGATAATCCT<br>GCCGCTGGCCTTTGCACAAGGCAAGGCCGCGAGTTTATCTGGAACGATTTGCTGAGTCTTGAAACAGG<br>CCTGATAAAGCTCGCAAACGGAAGAGTTATCGAAAAACAATCTATAACAAAAAAATAGGGCGGGATG<br>AACCGGCTCTATTCGTTGCCTTAACATTTGAGCGCCGGGAAGTTGTTGATCCATCAAATATAAAGCCTGT<br>AAACCCTTATAGGCGTTGACCGCGGCGAAAACATCCCGGCGGTTATTGCATTGACAGACCCTGAAGGTTG<br>TCCTTTACCGGAATTCAAGGATTCATCAGGGGGCCCAACAGACATCCTGCGAATAGGAGAAGGATATAA<br>GGAAAAGCAGAGGGCTATTCAGGCAGCAAAGGAGGTAGAGCAAAGGCGGGCTGGCGGTTATTCACGGA<br>AGTTTGCATCCAAGTCGAGGAACCTGGCGGACGACATGGTGGAAATTCAGCGCGAGACCTTTTTTACC<br>ATGCCGTTACCCACGATGCCGTCCTTGTCTTTGAAAACCTGAGCAGGGGTTTTGGAAGGCAGGGCAAAA<br>GGACCTTCATGACGGAAAGACAATATACAAAGATGGAAGACTGGCTGACAGCGAAGCTCGCATACGAA<br>GGTCTTACGTCAAAAACCTACCTTTCAAAGACGCTGGCGCAATATACGTCAAAAACATGCTCCAACTGC<br>GGGTTTACTATAACGACTGCCGATTATGACGGGATGTTGGTAAGGCTTAAAAAGACTTCTGATGGATGG<br>GCAACTACCCTCAACAACAAAGAATTAAAAGCCGAAGGCCAGATAACGTATTATAACCGGTATAAAAG<br>GCAAACCGTGGAAAAAGAACTCTCCGCAGAGCTTGACAGGCTTTCAGAAGAGTCGGGCAATAATGATAT<br>TTCTAAGTGGACCAAGGGTCGCCGGGACGAGGCATTATTTTTGTTAAAGAAAAGATTCAGCCATCGGCC<br>TGTTCAGGAACAGTTTGTTTGCCTCGATTGCGGCCATGAAGTCCACGCCGATGAACGGAGCAGCCTTGAAT<br>ATTGCAAGGTCATGGCTTTTTCTAAACTCAAATTCAACAGAATTCAAAAGTTATAAATCGGGTAAACAG<br>CCCTTCGTTGGTGCTTGGCAGGCCTTTTACAAAAGGAGGCTTAAAGAGGTATGGAAGCCCAACGCC |
| SEQ ID NO: 40 | ATGAAAAGGATAAATAAAATACGAAGGAGATTGGTAAAGGATAGCAACACGAAAAAAGCCGGCAAAA<br>CCGGCCCTATGAAAACCTTGCTCGTTCGGGTTATGACACCTGACCTGAGAGAAAGGTTAGAGAATCTTC<br>GCAAAAAGCCGGAAAACATTCCTCAGCCCATTTCAAATACTTCACGTGCAAATTTAAATAAACTCCTCA<br>CTGACTATACGGAAATGAAGAAAGCAATCCTGCATGTTATTGGGAAGAGTTCCAAAAAGACCCTGTCG<br>GATTGATGAGCAGGGTTGCACAACCAGCGCCCAAGAATATTGATCAGAGAAAATTGATTCCGGTGAAGG<br>ACGGAAATGAGAGACTAACAAGTTCTGGATTTGCCTGTTCTCAGTGCTGTCAACCCCTCTATGTTTATAA<br>GCTTGAACAAGTGAATGACAAGGGTAAGCCCCATACAAATTACTTTGGCCGTTGTAATGTCTCCGAGCA<br>TGAACGTTTGATATTGCTCTCGCGCATAAACCGGAGGCAAATGACGAGCTAGTAACGTATTCGTTGGG<br>GAAGTTCGGTCAAAGGGCATTGGACTTTTATTCAATCCACGTAACAAGAGAATCGAACCATCCTGTAAA<br>GCCGCTAGAACAGATCGGTGGCAATAGCTGCGCAAGTGGTCCCGTTGGTAAGGCTTTATCTGATGCCTG<br>TATGGGAGCAGTAGCCAGTTTCCTTACAAAGTACCAGGACATCATCCTCGAACACCAAAAGGTTATAAA<br>AAAAAACGAAAAGAGATTGGCAAATCAAAGGATATAGCAAGTGCAAACGGGCTTGCATTTCCTAAAA<br>TCACTCTTCCACCGCAACCGCATACAAAAGAAGGGATTGAAGCTTATAACAATGTTGTTGCTCAGATAG<br>TGATCTGGGTAAACTCGAATCTTTGGCAGAAACTCAAAATTGGCAGGGATGGAGGCAAGGCCCTTACAG<br>GGCTTAAGGGTTTCCGTCCTTCCCTCTTGTTGAACGCCAGGCGAATGAGGTTGATTGGTGGGATATGGT<br>CTGTAATGTCAAAAAGTTGATTAACGAAAGAAAGAGGACGGGAAGGTCTTCTGGCAAAATCTTGCTGG<br>ATATAAAGGCAGGAAGCCTTGCTTCCATATCTTTCGTCTGAAGAAGACCGTAAAAAAGGAAAAAAGTT<br>TGCGCGTTATCAGTTTGGTGACCTTTTGCTTCACCTTGAAAAGAAACACGGTGAAGATTGGGGCAAAGTT<br>TATGATGAGGCATGGGAAAGAATAGATAAAAAAGTTGAAGGTCTGAGTAAGCACATAAAGTTGGAGGA |

TABLE 5-continued

| SEQ ID NO | Sequence |
|---|---|
| | AGAAAGAAGGTCTGAAGATGCTCAATCAAAGGCTGCCCTCACTGATTGGCTCAGGGCAAAGGCCTCTTT<br>TGTTATTGAAGGGCTCAAAGAAGCTGATAAGGATGAGTTTTGCAGGTGTGAGTTAAAGCTTCAAAAGTG<br>GTATGGAGATTTGAGAGGAAAACCATTTGCTATAGAAGCAGAGAACAGCATTTTAGATATAAGCGGATT<br>TTCTAAACAGTATAATTGTGCATTTATATGGCAGAAAGACGGCGTAAAGAAGTTAAATCTTTATTTAATA<br>ATAAATTACTTCAAAGGTGGTAAGCTACGCTTCAAAAAAATCAAGCCAGAAGCTTTTGAAGCAAATAGG<br>TTTTATACAGTAATTAATAAAAAAAGCGGTGAGATTGTGCCTATGGAGGTCAACTTCAATTTTGATGACC<br>CGAATTTGATAATTCTGCCTTTGGCCTTTGGAAAAAGGCAGGGGAGGGAGTTTATCTGGAACGACCTATT<br>GAGCCTTGAGACGGGTTCATTGAAACTCGCCAATGGCAGGGTTATTGAAAAAACGCTCTATAACAGAAG<br>GACGAGACAGGATGAACCAGCACTTTTTGTTGCCCTGACATTTGAAAGAAGAGGTGCTTGACTCATC<br>GAATATAAAACCGATGAATCTGATAGGAATAGACCGGGGAGAAAATATCCCGGCAGTCATAGCATTAA<br>CAGACCCGGAAGGATGCCCCTTGTCAAGATTCAAAGATTCATTGGGCAATCCAACGCATATTTTGCGAA<br>TAGGAGAAAGTTATAAGGAAAAACAACGGACTATTCAGGCTGCTAAAGAAGTTGAACAAAGGCGGGCA<br>GGCGGATATTCGAGAAAATATGCATCAAAGGCGAAGAATCTGGCGGACGATATGGTAAGAAATACAGC<br>TCGTGACCTCTTATATTATGCTGTTACTCAAGATGCAATGCTCATTTTTGAAAATCTTTCCCGCGGTTTTG<br>GTAGACAAGGCAAGAGGACTTTTATGGCGGAAAGGCAGTACACGAGGATGGAAGACTGGCTGACTGCA<br>AAGCTTGCCTATGAAGGTCTGCCATCAAAAACCTATCTTTCAAAGACTCTGGCACAGTATACCTCAAAG<br>ACATGTTCTAATTGTGGTTTTACAATCACAAGTGCAGATTATGACAGGGTGCTCGAAAAGCTCAAGAAG<br>ACGGCTACTGGATGGATGACTACAATCAATGGAAAAGAGTTAAAAGTTGAAGGACAGATAACATACTA<br>TAACCGGTATAAAAGGCAGAATGTGGTAAAAGACCTCTCTGTAGAGCTGGATAGACTTTCGGAAGAGTC<br>GGTAAATAATGATATTTCTAGTTGGACAAAAGGCCGCAGTGGTGAAGCTTTATCTCTGCTAAAAAAGAG<br>ATTTAGTCACAGGCCGGTGCAGGAAAAGTTTGTTTGCCTGAACTGTGGTTTTGAAACCCATGCAGACGA<br>ACAAGCAGCACTGAATATTGCAAGGTCGTGGCTCTTTCTCCGTTCTCAAGAATATAAGAAGTATCAAAC<br>CAATAAAACGACCGGAAATACTGACAAAAGGGCATTTGTTGAAACATGGCAATCCTTTTACAGAAAGAA<br>GCTCAAAGAAGTATGGAAACCA |
| SEQ ID NO: 41 | ATGGGTAAAATGTATTACCTTGGTTTAGACATTGGCACGAATTCCGTGGGCTACGCGGTGACCGACCCCT<br>CATACCACCTGCTGAAGTTTAAGGGGGAACCAATGTGGGGTGCGCACGTATTTGCCGCCGGTAATCAGA<br>GCGCGGAACGACGCTCGTTCCGCACATCGCGTCGTCGTTTGGACCGACGCCAACAGCGCGTTAAACTGG<br>TACAGGAGATTTTTGCCCCGGTGATTAGTCCGATCGACCCACGCTTCTTCATTCGTCTGCATGAATCCGC<br>CCTGTGGCGCGATGACGTCGCGGAGACGGATAAACATATCTTTTTCAATGATCCTACCTATACCGATAAG<br>GAATATTATAGCGATTACCCGACTATCCATCACCTGATCGTTGATCTGATGGAAAGCTCTGAGAAACAC<br>GATCCGCGGCTGGTGTACCTTGCAGTGGCGTGGTTAGTGGCACACCGTGGTCATTTTCTGAACGAGGTGG<br>ACAAGGATAATATTGGAGATGTGTTGTCGTTCGACGCATTTTATCCGGAGTTTCTCGCGTTCCTGTCGGA<br>CAACGGTGTATCACCGTGGGTGTGCGAAAGCAAAGCGCTGCAGGCGACCTTGCTGAGCCGTGAATGCT<br>GAACGACAAATATAAAGCCCTTAAGTCTCTGATCTTCGGATCCCAGAAACCTGAAGATAACTTCGATGC<br>CAATATTTCGGAAGATGGACTCATTCAACTGCTGGCCGGCAAAAAGGTAAAAGTTAACAAACTGTTCCC<br>TCAGGAATCGAACGATGCATCCTTCACATTGAATGATAAAGAAGACGCGATAGAAGAAATCCTGGGTAC<br>GCTTACACCAGATGAATGTGAATGGATTGCGACATATACGCCGCTCTTTTTGACTGGGCTATCATGAAACAT<br>GCTCTGAAAGATGGCAGGACTATTAGCGAGTCAAAAGTCAAACTGTATGAGCAGCACCATCACGATCTG<br>ACCCAACTTAAATACTTCGTGAAAACCTACCTTGCAAAAGAATACGACGATATTTTCCGCAACGTGGAT<br>AGCGAAACAACGAAAAACTATGTAGCGTATTCCTATCATGTGAAAGAGGTGAAAGGCACTCTGCCTAAA<br>AATAAGGCAACGCAAGAAGAGTTTTGTAAGTATGTCCTGGGCAAGGTTAAAAACATTGAATGCTCTGAA<br>GCAGACAAGGTTGACTTTGATGAGATGATTCAGCGTCTTACCGACAACTCTTTTATGCCTAAGCAGGTTT<br>CGGGCGAAAACCGCGTTATTCCTTATCAGTTATATTATTATGAACTGAAGACAATTCTGAATAAAGCAGC<br>CTCGTACCTGCCTTTCCTGACGCAGTGTGGAAAAGATGCAATTTCGAACCAGGACAAACTACTGTCGATC<br>ATGACGTTCCGTATTCCTTACTTCGTCGGACCCTTGCGAAAAGATAATTCGAAAGACATGGCTCGAAC<br>GAAAGGCCGGTAAGATTTATCCGTGGAACTTTAACGACAAAGTGGACTTGGATAAATCAGAAGAAGCGT<br>TCATTCGCCGAATGACCAATACCTGTACCTATTATCCCGGCGAAGATGTTTTACCGTTGGATTCGCTGAT<br>CTATGAGAAATTTATGATTTTAAATGAAATCAATAATATTCGTATTGACGGCTACCCGATTAGTGTTGAC<br>GTTAAACAGCAGGTTTTTGGCTTGTTCGAAAAAAAACGACGGTACCGTGAAAGATATTCAGAACCTG<br>CTGCTGTCTCTCGGAGCTCTGGACAAACACGGGAAGCTGACAGGCATCGATACCACTATCCACTCAAAC<br>TATAATACGCTATCACCATTTTAAATCTCTCATGGAACGCGGCGTCCTGACCCGGGATGACGTGGAACGC<br>ATCGTTGAAAGGATGACCTACAGCGACGATACTAAGCGTGTGCGTCTGTGGCTGAATAACAACTATGGT<br>ACTTTAACCGCCGACGATGTGAAACACATTTCGCGTCTGCGCAAACACGATTTTGGCCGTTTATCCAAAA<br>TGTTCTTAACAGGTCTGAAGGGTGTCCATAAGGAGACCGGTGAACGTGCCTCCATACTGGATTTCATGTG<br>GAACACGAACGATAACCTGATGCAGCTCCTTTCCGAATGCTACACGTTCAGTGATGAAATCACAAAGCT<br>GCAAGAGGCGTATTATGCAAAAGCCCAGTTGTCTTTAAACGATTTTTTAGACTCGATGTACATCTCTAAC<br>GCGGTGAAACGTCCGATTTACAGAACTCTGGCAGTGGTGAACGATATTCGAAAAGCATGTGGGACGGCC<br>CCTAAACGCATTTTCATCGAAATGGCTCGTCGATGGTGAATCAAAAAAAAGAGAAGTGTTACACGTCGC<br>GAGCAGATCAAAAACCTGTACCGCTCGATTCGTAAAGATTTCCAGCAGGAAGTTGATTTTCTGGAAAAG<br>ATCCTGGAAATAAATCTGATGGTCAACTTCAGTCAGATGCTTTGTATCTTTACTTTGCACAATTAGGGC<br>GCGATATGTACACGGGCGATCCAATAAAGCTGGAGCACATCAAAGATCAGATTTCTATAACATAGACC<br>ATATTTACCCGCAGTCTATGGTGAAAGACGATTCCCTAGATAACAAAGTGCTGGTGCAAAGCGAAATTA<br>ACGGCGAGAAAAGCTCGCGATACCCTTTGGACGCCGCGATCCGCAATAAAATGAAGCCCCTTTGGGACG<br>CTTACTATAATCATGGCCTGATCTCCTTAAAGAAATACCAGCGTCTAACGCGCTCGACCCCGTTTACCGA<br>TGATGAAAATGGGACTTTATTAATCGCCAGTTAGTGGAAACCCGTCAATCTACCAAAGCGCTGGCCAT<br>TTTGTTGAAGCGTAAGTTTCCAGACACCGAAATTGTGTATTCGAAAGAGCGGGTTATCGTCGACTTCAGA<br>CATGAATTCGGCCTTGTAAAAAGTCGCAATATTAATGATTTGCACCACGCTAAAGACGCATTCTTGGCTA<br>TCGTTACCGGCAATGTGTACCATGAAGATTCAATCGCAGATGGTTTATGGTGAACCAGCCGTACTCAGT<br>TAAAACTAAAACTCTTTTTACCCACAGCATAAAGAATGGCAACTTCGTTGCCTGGAACGGCGAAGAAGA<br>TCTCGGTCGTATTGTAAAAATCGTGAAGCAAAACAAAAAATACCATTCACTTCACGCAGTCTCCTTCGAT<br>CGCAAAGAAGGATTATTTGATATCCAACCTCTGAAAGCCAGCACCGGCTTAGTCCCACGAAAAGCCGGT<br>CTGGATGTCGTTAAATACGGCGGATATGACAAATCTACCGCGGCCTATTACCTGCTGGTGAGGTTCACGC<br>TCGAGGACAAGAAAACCCAGCACAAGCTGATGATGATTCCTGTAGAAGGCCTGTACAAGGCTCGCATTG<br>ATCATGACAAGGAATTTCTTACCGATTATGCGCAAACGACTATAAGCGAAATCCTACGAAAGATAAAC<br>AGAAAGTGATCAATATTATGTTTCCAATGGGTACGAGGCATATAAAACTCAATTCAATGATTAGTATCG |

TABLE 5-continued

| SEQ ID NO | Sequence |
|---|---|
| | ATGGCTTCTATCTTAGTATCGGCGGAAAGTCCTCTAAAGGTAAGTCAGTTCTATGTCACGCAATGGTTCC
ACTGATCGTCCCTCACAAAATCGAATGTTACATTAAAGCAATGGAAAGCTTCGCCCGGAAGTTTAAGA
AAACAACAAGCTGCGCATCGTAGAAAAATTCGATAAAATCACCGTTGAAGACAACCTGAATCTCTACGA
GCTCTTTCTCCAAAAACTGCAGCATAATCCCTATAATAAGTTTCTTTTTCGACACAGTTTGACGTACTGACG
AACGGCCGTTCTACTTTCACAAAACTGTCGCCGGAGGAACAGGTACAGACGCTCTTGAACATTTTAAGT
ATCTTTAAAACATGCCGCAGTTCGGGTTGCGACCTGAAATCCATCAACGGCAGTGCCCAGGCAGCGCGC
ATCATGATTAGCGCTGACTTAACTGGACTGTCGAAAAAATATTCAGATATTAGGTTGGTTGAACAGTCA
GCTTCTGGTTTGTTCGTATCCAAAAGTCAGAACTTACTGGAGTATCTCTAA |
| SEQ ID NO: 42 | ATGTCATCGCTCACGAAATTCACTAACAAATACTCTAAACAGCTCACCATTAAGAATGAACTCATCCCA
GTTGGCAAAACACTGGAGAACATCAAGAGAATGGTCTGATAGATGGCGACGAACAGCTGAATGAGAA
TTATCAGAAGGCGAAAATTATTGTGGATGATTTTCTGCGGGACTTCATTAATAAAGCACTGAATAATACG
CAGATCGGGAACTGGCGCGAACTGGCGGATGCCCTTAATAAAGAGGATGAAGATAACATCGAGAAATT
GCAGGATAAAATTCGGGGAATCATTGTATCCAAATTTGAAACGTTTGATCTGTTTAGCAGCTATTCTATT
AAGAAAGATGAAAAGATTATTGACGACGACAATGATGTTGAAGAAGAGGAACTGGATCTGGGCAAGAA
GACCAGCTCATTTAAATACATATTTAAAAAAAACCTGTTTAAGTTAGTGTTGCCATCCTACCTGAAAACC
ACAAACCAGGACAAGCTGAAGATTATTAGCTCGTTTGATAATTTTTCAACGTACTTCCGCGGGTTCTTTG
AAAACCGGAAAAACATTTTTACCAAGAAACCGATCTCCACAAGTATTGCGTATCGCATTGTTCATGATA
ACTTCCCGAAATTCCTTGATAACATTCGTTGTTTTAATGTGTGGCAGACGGAATGCCCGCAACTAATCGT
GAAAGCAGATAACTATCTGAAAAGCAAAAATGTTATAGCGAAAGATAAAGTTTGGCAAACTATTTTAC
CGTGGGCGCGTATGCATATTTCCTGTCTCAGAATGGTATAGATTTTTACAACAATATTATAGGTGGACTG
CCAGCGTTCGCCGGCCATGAGAAAATCCAAGGTCTCAATGAATTCATCAATCAAGAGTGCCAAAAAGAC
AGCGAGCTGAAAAGTAAGCTGAAAAACCGTCACGCGTTCAAAATGGCGGTACTGTTCAAACAGATACTC
AGCGATCGTGAAAAAAGTTTTGTAATTGATGAGTTCGAGTCGGATGCTCAAGTTATTGACGCCGTTAAA
AACTTTTTACGCCGAACAGTGCAAAGATAACAATGTTATTTTTAACTTATTAAATCTTATCAAGAATATCG
CTTTCTTAAGTGATGACGAACTGGACGGCATATTCATTGAAGGGAAATACCTGTCGAGCGTTAGTCAAA
AACTCTATAGCGATTGGTCAAAATTACGTAACGACATTGAGGATTCGGCTAACTCTAAACAAGGCAATA
AAGAGCTGGCCAAGAAGATCAAACCAACAAAGGGGATGTAGAAAAAGCGATCTCGAAATATGAGTTC
TCGCTGTCGGAACTGAACTCGATTGTACATGATAACACCAAGTTTTCTGACCTCCTTAGTTGTACACTGC
ATAAGGTGGCTTCTGAGAAACTGGTGAAGGTCAATGAAGGCGACTGGCCGAAACATCTCAAGAATAAT
GAAGAGAAACAAAAATCAAAGAGCCGCTTGATGCTCTGCTGGAGATCTATAATACACTTCTGATTTTT
AACTGCAAAAGCTTCAATAAAAACGGCAACTTCTATGTCGACTATGATCGTTGCATCAATGAACTGAGT
TCGGTCGTGTATCTGTATAATAAAACACGTAACTATTGCACTAAAAAACCTATAACACGGACAAGTTC
AAACTCAATTTTAACAGTCCGCAGCTCGGTGAAGGCTTTTCCAAGTCGAAAGAAAATGACTGTCTGACT
CTTTTGTTTAAAAAGACGACAACTATTATGTAGGCATTATCCGCAAAGGTGCAAAAATCAATTTTGATG
ATACACAAGCAATCGCCGATAACACCGACAATTGCATCTTTAAAATGAATTATTTCCTACTTAAAGACGC
AAAAAAATTTATCCCGAAATGTAGCATTCAGCTGAAAGAAGTCAAGGCCCATTTTAAGAAATCTGAAGA
TGATTACATTTTGTCTGATAAAGAGAAATTTGCTAGCCCGCTGGTCATTAAAAAGACACATTTTTGCTG
GCAACTGCACATGTGAAAGGGAAAAAAGGCAATATCAAGAAATTTCAGAAAGAATATTCGAAAGAAAA
CCCCACTGAGTATCGCAATTCTTTAAACGAATGGATTGCTTTTTGTAAAGAGTTCTTAAAAACTTATAAA
GCGGCTACCATTTTTGATATAACCACATTGAAAAAGGCAGAGGAATATGCTGATATTGTAGAATTCTAC
AAGGATGTCGATAATCTGTGCTACAAACTGGAGTTCTGCCCGATTAAAACCTCGTTTATAGAAAACCTG
ATAGATAACGGCGACCTGTATCTGTTTCGCATCAATAACAAAGACTTCAGCAGTAAATCGACCGGCACC
AAGAACCTTCATACGTTATATTTACAAGCTATATTCGATGAACGTAATCTGAACAATCCGACAATTATGC
TGAATGGGGGAGCAGAACTGTTCTATCGTAAAGAAAGTATTGAGCAGAAAACCGTATCACACACAAA
GCCGGTTCAATTCTCGTGAATAAGGTGTGTAAAGACGGTACAAGCCTGGATGATAAGATACGTAATGAA
ATTTATCAATATGAGAATAAATTTATTGATACCCTGTCTGATGAAGCTAAAAAGGTGTTACCGAATGTCA
TTAAAAAGGAAGCTACCCATGACATTACAAAAGATAAACGTTTCACTAGTGACAAATTCTTCTTTCACTG
CCCCCTGACAATTAATTATAAGGAAGGCGATACCAAGCAGTTCAATAACGAAGTGCTGAGTTTTCTGCG
TGGAAATCCTGACATCAACATTATCGGCATTGACCGCGGAGAGCGTAATTTAATCTATGTAACGGTTATA
AACCAGAAAGGCGAGATTCTGGATTCGGTTTCATTCAATACCGTGACCAACAAGAGTTCAAAAATCGAG
CAGACAGTCGATTATGAAGAGAAATTGGCAGTCCGCGAGAAGAGAGGATTGAAGCAAAACGTTCCTG
GGACTCTATCTCAAAAATTGCGACACTAAAGGAAGGTTATCTGAGCGCAATAGTTCACGAGATCTGTCT
GTTAATGATTAAACACAACGCGATCGTTGTCTTAGAGAATTTAATGCAGGCTTTAAGCGTATTCGTGGC
GGTTTATCAGAAAAAAGTGTTTATCAAAAATTCGAAAAATGTTGATTAACAAACTGAACTATTTTGTCA
GCAAGAAGGAATCCGACTGGAATAAACCGTCTGGTCTGCTGAATGGACTGCAGCTTTCGGATCAGTTTG
AAAGCTTCGAAAAACTGGGTATTCAGTCTGGTTTTATTTTTACGTGCCGGCTGCATATACCTCAAAGAT
TGATCCGACCACGGGCTTCGCCAATGTTCTGAATCTGTCGAAGGTACGCAATGTTGATGCGATCAAAAG
CTTTTTTTCTAACTTCAACGAAATTAGTTATACGAAGAAAGAAGCCCTTTTCAAATTCTCATTCTGG
ATTCACTGAGTAAGAAAGCTTTAGTAGCTTTGTGAAATTTAGTAAGAGTAAATGGAACGTTCACACCTT
TGGAGAACGTATCATAAAGCCAAAGAATAAGCAAGGTTATCGGGAGGACAAAAGAATCAACTTGACCT
TCGAGATGAAGAAGTTACTTAACGAGTATAAGGTTTCTTTTGATCTTGAAAATAACTTGATTCCGAATCT
CACGGATGCCAACCTGAAGGATACTTTTTGGAAAGAGCTATTCTTTATCTTCAAGACTACGCTGCACTC
CGTAACAGCGTTACTAACGGTAAAGAAGATGTGCTCATCTCTCCGGTCAAAAATGCGAAGGGTGAATTC
TTCGTTTCGGGAACGCATAACAAGACTCTTCCGCAAGATTGCGATGCGAACGGTGCATACCATATTGCGT
TGAAAGGTCTGATGATACTCGAACGTAACAACCTTGTACGTGAGGAGAAAGATACGAAAAAGATTATG
GCGATTTCAAACGTGGATTGGTTCGAGTACGTGCAGAAACGTAGAGGCGTTCTGTAA |
| SEQ ID NO: 43 | ATGAACAACTACGACGAATTCACCAAACTGTACCCGATCCAGAAACCATCCGTTTCGAACTGAAACCG
CAGGGTCGTACCATGGAACACCTGGAAACCTTCAACTTCTTCGAAGAAGACCGTGACCGTGCGGAAAAA
TACAAAATCCTGAAAGAAGCGATCGACGAATACAACACCAAAAATTCATCGCAAGAACACCTGACCAACAT
GTCTCTGGACTGGAACTCTCTGAAACAGATCTCTGAAAATACTACAAATCTCGTGAAGAAAAAGACAA
AAAAGTTTTCCTGTCTGAACAGAAACGTATGCGTCAGGAATCGTTTCTGAATTCAAAAAGACGACCG
TTTCAAAGACCTGTTCTCTAAAAAACTGTTCTCTGAACTGCTGAAAGAAGAAATCTACAAAAAAGGTAA
CCACCAGGAAATCGACGCGCTGAAATCTTTCGACAAATTCTCTGTTACTTCATCGGTCTGCACGAAAAC
CGTAAAAACATGTACTCTGACGGTGACGAAATCACCGCGATCTCTAACCGTATCGTTAACGAAAACTTC |

TABLE 5-continued

| SEQ ID NO | Sequence |
|---|---|
| | CCGAAATTCCTGGACAACCTGCAGAAATACCAGGAAGCGCGTAAAAAATACCCGGAATGGATCATCAA<br>AGCGGAATCTGCGCTGGTTGCGCACAACATCAAAATGGACGAAGTTTTCTCTCTGGAATACTTCAACAA<br>AGTTCTGAACCAGGAAGGTATCCAGCGTTACAACCTGGCGCTGGGTGGTTACGTTACCAAATCTGGTGA<br>AAAAATGATGGGTCTGAACGACGCGCTGAACCTGGCGCACCAGTCTGAAAAATCTTCTAAAGGTCGTAT<br>CCACATGACCCCGCTGTTCAAACAGATCCTGTCTGAAAAAGAATCTTTCTCTTACATCCCGGACGTTTTC<br>ACCGAAGACTCTCAGCTGCTGCCGTCTATCGGTGGTTTCTTCGCGCAGATCGAAACGACAAAGACGGT<br>AACATCTTCGACCGTGCGCTGGAACTGATCTCTTCTTACGCGGAATACGACACCGAACGTATCTACATCC<br>GTCAGGCGGACATCAACCGTGTTTCTAACGTTATCTTCGGTGAATGGGGTACCCTGGGTGGTCTGATGCG<br>TGAATACAAAGCGGACTCTATCAACGACATCAACCTGGAACGTACCTGCAAAAAAGTTGACAAATGGCT<br>GGACTCTAAAGAATTCGCGCTGTCTGACGTTCTGGAAGCGATCAAACGTACCGGTAACAACGACGCGTT<br>CAACGAATACATCTCTAAAATGCGTACCGCGCGTGAAAAAATCGACGCGGCGCGTAAAGAAATGAAAT<br>TCATCTCTGAAAAAATCTCTGGTGACGAAGAATCTATCCACATCATCAAACCCTGCTGGACTCTGTTCA<br>GCAGTTCCTGCACTTCTTCAACCTGTTCAAAGCGCGTCAGGACATCCCGCTGGACGGTCGGTTCTACGCG<br>GAATTCGACGAAGTTCACTCTAAACTGTTCGCGATCGTTCCGCTGTACAACAAAGTTCGTAACTACCTGA<br>CCAAAAACAACCTGAACACCAAAAAAATCAAACTGAACTTCAAAAACCCGACCCTGGCGAACGGTTGG<br>GACCAGAACAAAGTTTACGACTACGCGTCTCTGATCTTCCTGCGTGACGGTAACTACTACCTGGGTATCA<br>TCAACCCGAAACGTAAAAAAACATCAAATTCGAACAGGGTTCTGGTAACGGTCCGTTCTACCGTAAAA<br>TGGTTTACAAACAGATCCCGGGTCCGAACAAAAACCTGCCGCGTGTTTTCCTGACCTCTACCAAAGGTA<br>AAAAAGAATACAAACCGTCTAAAGAAATCATCGAAGGTTACGAAGCGGACAAACACATCCGTGGTGAC<br>AAATTCGACCTGGACTTCTGCCACAAACTGATCGACTTCTTCAAAGAATCTATCGAAAAACACAAAGAC<br>TGGTCTAAATTCAACTTCTACTTCTCTCCGACCGAATCTTACGGTGACATCTCTGAATTCTACCTGGACGT<br>TGAAAAACAGGGTTACCGTATGCACTTCGAAAACATCTCTGCGGAAACCATCGACGAATACGTTGAAAA<br>AGGTGACCTGTTCCTGTTCCAGATCTACAACAAAGACTTCGTTAAAGCGGCGACCGGTAAAAAAGACAT<br>GCACACCATCTACTGGAACGCGGCGTTCTCTCCGGAAAACCTGCAGGACGTTGTTGTTAAACTGAACGG<br>TGAAGCGGAACTGTTCTACCGTGACAAATCTGACATCAAAGAAGTCGTTCACCGTGAAGGTGAAATCCT<br>GGTTAACCGTACCTACAACGGTCGTACCCCGGTTCCGGACAAAATCCACAAAAAACTGACCGACTACCA<br>CAACGGTCGTACCAAAGACCTGGGTGAAGCGAAAGAATACCTGGACAAAGTTCGTTACTTCAAAGCGCA<br>CTACGACATCACCAAAGACCGTCGTTACCTGAACGACAAAATCTACTTCCACGTTCCGCTGACCCTGAAC<br>TTCAAAGCGAACGGTAAAAAAAACCTGAACAAAATGGTTATCGAAAAATTCCTGTCTGACGAAAAAGC<br>GCACATCATCGGTATCGACCGTGGTGAACGTAACCTGCTGTACTACTCTATCATCGACCGTTCTGGTAAA<br>ATCATCGACCAGCAGTCTCTGAACGTTATCGACGGTTTCGACTACCGTGAAAAACTGAACCAGCGTGAA<br>ATCGAAATGAAAGACGCGCGTCAGTCTTGGAACGCGATCGGTAAAATCAAAGACCTGAAAGAAGGTTA<br>CCTGTCTAAAGCGGTTCACGAAATCACCAAAATGGCGATCCAGTACAACGACGTCGTTGTTATGGAAGA<br>ACTGAACTACGGTTTCAAACGTGGTCGTTTCAAAGTTGAAAAACAGATCTACCAGAAAATTCGAAAACAT<br>GCTGATCGACAAAATGAACTACCTGGTTTTCAAAGACGCGCCGGACGAATCTCCGGGTGGTGTTCTGAA<br>CGCGTACCAGCTGACCAACCCGCTGGAATCTTTCGCGAAACTGGGTAAACAGACCGGTATCCTGTTCTA<br>CGTTCCGGCGGCGTACACCTCTAAAATCGACCCGACCACCGGTTTCGTTAACCTGTTCAACACCTCTTCT<br>AAAACCAACGCGCAGGAACGTAAAGAATTCCTGCAGAAATTCGAATCTATCTCTTACTCTGCGAAAGAC<br>GGTGGTATCTTCGCGTTCGCGTTCGACTACCGTAAATTCGGTACCTCTAAAACCGACCACAAAACGTTT<br>GGACCGCGTACACCAACGGTGAACGTATGCGTTACATCAAAGAAAAAAAACGTAACGAACTGTTCGAC<br>CCGTCTAAAGAAATCAAAGAAGCGCTGACCTCTTCTGGTATCAAATACGACGGTGGTCAGAACATCCTG<br>CCGGACATCCTGCGTTCTAACAACAACGGTCTGATCTACACCATGTACTCTTCTTTCATCGGCGGATCC<br>AGATGCGTGTTTACGACGGTAAAGAAGACTACATCATCTCTCCGATCAAAAACTCTAAAGGTGAATTCT<br>TCCGTACCGACCCGAAACGTCGTGAACTGCCGATCGACGCGGACGCGAACGGTGCGTACAACATCGCGC<br>TGCGTGGTGAACTGACCATGCGTGCGATCGCGGAAAAATTCGACCCGGACTCTGAAAAAATGGCGAAAC<br>TGGAACTGAAACACAAAGACTGGTTCGAATTCATGCAGACCCGTGGTGACTAA |
| SEQ ID NO: 44 | ATGACTAAAACATTTGATTCAGAGTTTTTTAATTTGTACTCGCTGCAAAAAACGGTACGCTTTGAGTTAA<br>AACCCGTGGGAGAAACCGCGTCATTTGTGGAAGACTTTAAAAACGAGGGCTTGAAACGTGTTGTGAGCG<br>AAGATGAAAGGCGAGCCGTCGATTACCAGAAAGTTAAGGAAATAATTGACGATTACCATCGGGATTTCA<br>TTGAAGAAAGTTTAAATTATTTTCCGGAACAGGTGAGTAAAGATGCTCTTGAGCAGGCGTTTCATCTTTA<br>TCAGAAACTGAAGGCAGCAAAAGTTGAGGAAAGGGAAAAAGCGCTGAAAGAATGGGAAGCGCTGCAG<br>AAAAAGCTACGTGAAAAAGTGGTGAAATGCTTCTCGGACTCGAATAAAGCCCGCTTCTCAAGGATTGAT<br>AAAAAGGAACTGATTAAGGAAGACCTGATAAATTGGTTGGTCGCCCAGAATCGCGAGGATGATATCCCT<br>ACGGTCGAAACGTTTAACAACTTCACCACATATTTTACCGGCTTCCATGAGAATCGTAAAAATATTTACT<br>CCAAAGATGATCACGCCACCGCTATTAGCTTTGCCTTATTCATGAAAATCTTCCAAAGTTTTTTGACAA<br>CGTGATTAGCTTCAATAAGTTGAAAGAGGGTTTCCCTGAATTAAAATTTGATAAAGTGAAAGAGGATTT<br>AGAAGTAGATTATGATCTGAAGCATGCGTTTGAAATAGAATATTTCGTTAACTTCGTGACCCAAGCGGG<br>CATAGATCAGTATAATTATCTGTTAGGAGGGAAAACCCTGGAGGACGGGACGAAAAAACAAGGGATGA<br>ATGAGCAAATTAATCTGTTCAAACAACAGCAAACGCGAGATAAAGCGCGTCAGATTCCCAAACTGATCC<br>CCCTGTTCAAACGATTCTTAGCGAAAGGACTGAAAGCCAGTCCTTTATTCCTAAACAATTTGAAAGTGA<br>TCAGGAGTTGTTCGATTCACTGCAGAAGTTACATAATAACTGCCAGGATAAATTCACCGTGCTGCAACA<br>AGCCATTCTCGGTCTGGCAGAGGCGGATCTTAAGAAGGTCTTCATCAAAACCTCTGATTTAAATGCCTTA<br>TCTAACACCATTTTCGGGAATTACAGCGCTCTTTTCCGATGCACTGAACCTGTATAAAGAAGCCTGAAAA<br>CGAAAAAGCGCAGGAGGCTTTTGAGAAACTACCGGCCCATTCTATTCACGACCTCATTCAATACTTGG<br>AACAGTTCAATTCCAGCCTGGACGCGGAAAAACAACAGAGCACCGACACCGTCCTGAACTACTTCATCA<br>AGACCGATGAATTATATTCTCGCTTCATTAAATCCACTAGCGAGGCTTTCACTCAGGTGCAGCCTTTGTT<br>CGAACTGGAAGCCCTGTCATCTAAGCGCCGCCCACCGGAATCGGAAGATGAAGGGGCAAAAGGGCAGG<br>AAGGCTTCGAGCAGATCAAGCGTATTAAAGCTTACCTGGATACGCTTATGGAAGCGGTACACTTTGCAA<br>AGCCGTTGTATCTTGTTAAGGGTCGTAAAATGATCGAAGGGCTCGATAAAGACCAGTCCTTTTATGAAG<br>CGTTTGAAATTGCGTACCAAGAACTTGAATCGTTAATCATTCCTATCTATAACAAAGCGCGGAGCTATCT<br>GTCGCGGAAACCTTTCAAGGCCGATAAATTCAAGATTAATTTTGACAACAACACGCTACTGAGCGGATG<br>GGATGCGAACAAGGAAACTGCTAACGCGTCCATTCTGTTTAAGAAAGACGGGTATATTACCTTGGAAT<br>TATGCCGAAAGGTAAGACCTTTCTCTTTGACTACTTTGTATCGAGCGAGGATTCAGAGAAACTGAAACA<br>GCGTCGCCAGAAGACCGCCGAAGAAGCTCTGGCGCAGGATGGTGAAAGTTACTTCGAAAAAATTCGTTA<br>TAAACTGTTACCAGGGGCTTCAAAGATGTTACCGAAAGTCTTTTTTAGCAACAAAAATATTGGCTTTTAC |

TABLE 5-continued

| SEQ ID NO | Sequence |
|---|---|
| | AACCCGTCGGATGACATTTTACGCATTCGCAACACAGCCTCTCACACCAAAAACGGGACCCCTCAGAAA<br>GGCCACTCAAAAGTTGAGTTTAACCTGAATGATTGTCATAAGATGATTGATTTCTTCAAATCATCAATTC<br>AGAAACACCCGGAATGGGGGTCTTTTGGCTTTACGTTTTCTGATACCAGTGATTTTGAAGACATGAGTGC<br>CTTCTACCGGGAAGTAGAAAACCAGGGTTACGTAATTAGCTTTGACAAAATCAAAGAGACCTATATACA<br>GAGCCAGGTGGAACAGGGTAATCTCTACTTATTCCAGATTTATAACAAGGATTTCTCGCCCTACAGCAA<br>AGGCAAACCAAACCTGCATACTCTGTACTGGAAAGCCCTGTTTGAAGAAGCGAACCTGAATAACGTAGT<br>GGCGAAGTTGAACGGTGAAGCGGAAATCTTCTTCCGTCGTCACTCCATTAAGGCCTCTGATAAAGTTGTC<br>CATCCGGCAAATCAGGCCATTGATAATAAGAATCCACACACGGAAAAAACGCAGTCAACCTTTGAATAT<br>GACCTCGTTAAAGACAAACGCTACACGCAAGATAAGTTCTTTTTCCACGTCCCAATCAGCCTCAACTTTA<br>AGCACAAGGGGTTTCAAAGTTTAATGATAAAGTCAATGGGTTCCTCAAGGGCAACCCGGATGTCAACA<br>TTATAGGTATAGACAGGGGCGAACGCCATCTGCTTTACTTTACCGTAGTGAATCAGAAAGGTGAAATAC<br>TGGTTCAGGAATCATTAAATACCTTGATGTCGGACAAAGGGCACGTTAATGATTACCAGCAGAAACTGG<br>ATAAAAAAGAACAGGAACGTGATGCTGCGCGTAAATCGTGGACCACGGTTGAGAACATTAAAGAGCTG<br>AAAGAGGGGTATCTAAGCCATGTGGTACACAAACTGGCGCACCTCATCATTAAATATAACGCAATAGTC<br>TGCCTAGAAGACTTGAATTTTGGCTTTAAACGCGGCCGCTTCAAAGTGGAAAAACAAGTTTATCAAAAA<br>TTTGAAAAGGCGCTTATAGATAAACTGAATTATCTGGTTTTTAAAGAAAAGGAACTTGGTGAGGTAGGG<br>CACTACTTGACAGCTTATCAACTGACGGCCCCGTTCGAATCATTCAGAAACACTGGGCAACAGTCTGGC<br>ATTCTGTTTTACGTGCCGGCAGATTATACTTCAAAAATCGATCCAACAACTGGCTTTGTGAACTTCCTGG<br>ACCTGAGATATCAGTCTGTAGAAAAAGCTAAACAACTTCTTAGCGATTTTAATGCCATTCGTTTTAACAG<br>CGTTCAGAATTACTTTGAATTCGAAATTGACTATAAAAAACTTACTCCGAAACGTAAAGTCGGAACCCA<br>AAGTAAATGGGTAATTTGTACGTATGGCGATGTCAGGTATCGAAACGTCGGAATCAAAAGGTCATTG<br>GGAGACCGAAGAAGTGAACGTGACCGAAAAGCTGAAGGCTCTGTTCGCCAGCGATTCAAAAACTACAA<br>CTGTGATCGATTACGCAAATGATGATAACCTGATAGATGTGATTTTAGAGCAGGATAAAGCCAGCTTTTT<br>TAAAGAACTGTTGTGGCTCCTGAAACTTACGATGACCTTACGACATTCCAAGATCAAATCGGAAGATGA<br>TTTTATTCTGTCACCGGTCAAGAATGAGCAGGGTGAATTCTATAGTAGGAAAGCCGGCGAAGTGTG<br>GCCGAAAGACGCCGACGCCAATGGCGCCTATCATATCGCGCTCAAAGGGCTTTGGAATTTGCAGCAGAT<br>TAACCAGTGGGAAAAAGGTAAAACCCTGAATCTGGCTATCAAAAACCAGGATTGGTTTAGCTTTATCCA<br>AGAGAAACCGTATCAGGAATGA |
| SEQ ID NO: 45 | ATGCATACAGGCGGTCTTCTTAGTATGGACGCGAAAGAGTTCACAGGTCAGTATCCGTTGTCGAAAACA<br>TTACGATTCGAACTTCGGCCCATCGGCCGCACGTGGGATAACCTGGAGGCCTCAGGCTACTTAGCGGAA<br>GACCGCCATCGTGCCGAATGTTATCCTCGTGCGAAAGAGTTATTGGATGACAACCATCGTGCCTTCCTGA<br>ATCGTGTGTTGCCACAAATCGATATGGATTGGCACCCGATTGCGGAGGCCTTTTGTAAGGTACATAAAA<br>ACCCTGGTAATAAAGAACTTGCCCAGGATTACAACCTTCAGTTGTCAAAGCGCCGTAAGGAGATCAGCG<br>CATATCTTCAGGATGCAGATGGCTATAAAGGCCTGTTCGCGAAGCCCGCCTTAGACGAAGCTATGAAAA<br>TTGCGAAAGAAACGGGAACGAAAGTGATATTGAGGTTCTCGAAGCGTTTAACGGTTTTAGCGTATACT<br>TCACCGGTTATCATGAGTCACGCGAGAACATTTATAGCGATGAGGATATGGTGAGCGTAGCCTACCGAA<br>TTACTGAGGATAATTTCCCGCTTTGTCTCAAACGCTTTGATCTTTGATAAATTAAACGAAAGCCATCC<br>GGATATTATCTCTGAAGTATCGGGCAATCTTGGAGTTGATGACATTGGTAAGTACTTTGACGTGTCGAAC<br>TATAACAATTTTCTTTCCCAGGCCGGTATAGATGACTACAATCACATTATTGGCGGCCATACAACCGAAG<br>ACGGACTGATACAAGCGTTTAATGTCGTATTGAACTTACGTCACCAAAAAGACCCTGGCTTTGAAAAAA<br>TTCAGTTCAAACAGCTCTACAAACAAATCCTGAGCGTGCGTACCAGCAAAGCTACATCCGAAGCAGT<br>TTGACAACTCTAAGGAGATGGTTGACTGCATTTGCGATTATGTCAGCAAAATAGAGAAATCCGAAACAG<br>TAGAACGGGCCCTGAAACTAGTCCGTAATATCAGTTCTTTCGACTTGCGCGGGATCTTTGTCAATAAAAA<br>GAACTTGCGCATACTGAGCAACAAACTGATAGGAGATTGGGACGCGATCGAAACCGCATTGATGCATAG<br>TTCTTCATCAGAAAACGATAAGAAAAGCGTATATGATAGCGCGGAGGCTTTTACGTTGATGACATCTTT<br>TCAAGCGTGAAAAATTTCTGATGCCTCTGCCGAAGATATTGGCAACAGGGCGGAAGACATCTGTAGA<br>GTGATAAGTGAGACGGCCCCTTTTATCAACGATCTGCGAGCGGTGGACCTGGATAGCCTGAACGACGAT<br>GGTTATGAAGCGGCCGTCTCAAAAATTCGGGAGTCGCTGGAGCCTTATATGGATCTTTTCCATGAACTGG<br>AAATTTTCTCGGTTGGCGATGAGTTCCCAAAATGCGGCAGCTTTACAGCGAACTGGAGGAAGTCAGCG<br>AACAGCTGATCGAAATTATTCCGTTATTCAACAAGGCGCGTTCGTTCTGCACCCGGAAACGCTATAGCAC<br>CGATAAGATTAAAGTGAACTTAAAATTCCCGACCTTGGCGGACGGGTGGGACCTGAACAAAGAGAGAG<br>ACAACAAAGCCGCGATTCTGCGGAAAGACGGTAAGTATTATCTGGCAATTCTGGATATGAAGAAAGATC<br>TGTCAAGCATTAGGACCAGCGACGAAGATGAATCCAGCTTCAGAAGATGGAGTATAAACTGTTACCGA<br>GTCCAGTAAAAATGCTGCCAAAGATATTCGTAAAATCGAAAGCCGCTAAGGAAAAATATGGCCTGACA<br>GATCGTATGCTTGAATGCTACGATAAAGGTATGCATAAGTCGGGTAGTGCGTTTGATCTTGGCTTTTGCC<br>ATGAACTCATTGATTATTACAAGCGTTGTATCGCGGAGTACCCAGGCTGGGATGTGTTCGATTTCAAGTT<br>TCGCGAAACTTCCGATTATGGGTCCATGAAAGAGTTCAATGAAGATGTGGCCGGAGCCGGTTACTATAT<br>GAGTCTGAGAAAAATTCCGTGCAGCGAAGTGTACCGTCTGTTAGACGAGAAATCGATTTATCTATTTCA<br>AATTTATAACAAAGATTACTCTGAAAATGCACATGGTAATAAGAACATGCATACCATGTACTGGGAGGG<br>TCTCTTTTCCCCGCAAAACCTGGAGTCGCCCGTTTTCAAGTTGTCGGGTGGGCAGAACTTTTCTTTCGA<br>AAATCCTCAATCCCTAACGATGCCAAAACAGTACACCCGAAAGGCTCAGTGCTGGTTCCACGTAATGAT<br>GTTAACGGTCGGCGTATTCCAGATTCAATCTACCGCGAACTGACACGCTATTTTAACCGTGGCGATTGCC<br>GAATCAGTGACGAAGCCAAAAGTTATCTTGACAAGGTTAAGACTAAAAAAGCGGACCATGACATTGTG<br>AAAGATCGCCGCTTTACCGTGGATAAAATGATGTTCCACGTCCCGATTGCGATGAACTTTAAGGCGATC<br>AGTAAACCGAACTTAAACAAAAAAGTCATTGATGGCATCATTGATGATCAGGATCTGAAATCATTGGT<br>ATTGATCGTGGCGAGCGGAACTTAATTTACGTCACGATGTTGACAGAAAAGGGAATATCTTATATCAG<br>GATTCTCTTAACATCCTCAATGGCTACGACTATCGTAAAGCTCTGGATGTGCGCGAATATGACAACAAG<br>GAAGCGCGTCGTAACTGGACTAAAGTGGAGGGCATTCGCAAAATGAAGGAAGGCTATCGTCATTAGCG<br>GTCTCGAAATTAGCGGATATGATTATCGAAAATAACGCCATCATCGTTATGGAGGACCTGAACCACGGA<br>TTCAAAGCGGGCCGCTCAAAGATTGAAAAACAAGTTTGATTACCGAAAACTGGGCTATATGGTGTTAAAAGACAAGTCAATTGACCAATCAGGTGGCGCGCTGCATGGATACCAGCTG<br>GCGAACCATGTTACCACCTTAGCATCAGTTGGAAAGCAGTGTGGGGTTATCTTTTATATACCGGCAGCGT<br>TCACTAGTAAAATAGATCCGACCACTGGTTTCGCCGATCTCTTTGCCCTGAGTAACGTTAAAAACGTAGC<br>GAGCATGCGTGAATTCTTTTCCAAAATGAAATCTGTCATTTATGATAAAGCTGAAGGCAAATTCGCATTC<br>ACCTTTGATTACTTGGATTACAACGTGAAGAGCGAATGTGGTCGTACGCTGTGGACCGTTTACACCGTTG |

TABLE 5-continued

| SEQ ID NO | Sequence |
|---|---|
| | GTGAGCGCTTCACCTATTCCCGTGTGAACCGCGAATATGTACGTAAAGTCCCCACCGATATTATCTATGA<br>TGCCCTCCAGAAAGCAGGCATTAGCGTCGAAGGAGACTTAAGGGACAGAATTGCCGAAAGCGATGGCG<br>ATACGCTGAAGTCTATTTTTTACGCATTCAAATACGCGCTAGATATGCGCGTTGAGAATCGCGAGGAAG<br>ACTACATTCAATCACCTGTGAAAAATGCCTCTGGGGAATTTTTTTGTCAAAAAATGCTGGTAAAAGCCT<br>CCCACAAGATAGCCATGCAAACGGTGCATATAACATTGCCCTGAAAGGTATTCTTCAATTACGCATGCT<br>GTCTGAGCAGTACGACCCCAACGCGGAATCTATTAGACTTCCGCTGATAACCAATAAAGCCTGGCTGAC<br>ATTCATGCAGTCTGGCATGAAGACCTGGAAAAATTAG |
| SEQ ID NO: 46 | ATGGATAGTTTAAAAGATTTTACGAATCTATATCCCGTAAGCAAAACTCTTCGTTTTGAACTGAAACCTG<br>TTGGAAAAACGTTGGAGAATATCGAGAAAGCGGGCATCCTGAAAGAAGACGAGCACCGTGCCGAAAGC<br>TACAGGCGTGTCAAAAGATTATCGATACTTATCACAAAGTGTTCATTGATAGCAGTCTGGAGAACATG<br>GCAAAAATGGGCATAGAAAATGAAATCAAAGCAATGCTGCAGAGCTTTTGCGAGCTCTACAAGAAAGA<br>TCACCGAACGGAAGGTGAAGATAAAGCACTGGACAAAATTCGCGCCGTTCTTCGCGGTCTGATTGTTGG<br>CGCGTTCACCGGCGTGTGCGGCCGCCGTGAAAACACCGTGCAGAACGAAAGTACGAGTCGCTGTTCAA<br>AGAAAAACTGATAAAGAAATTTTGCCTGACTTTGTGCTTTCGACCGAAGCGGAATCCCTGCCATTTTCT<br>GTCGAAGAAGCGACCCGCAGCCTGAAAGAATTTGACTCATTCACAAGTTACTTTGCAGGCTTCTACGAA<br>AACCGTAAAAACATCTACAGCACGAAGCCACAGAGCACGGCTATTGCTTATCGCCTGATTCATGAGAAC<br>CTGCCGAAGTTCATCGATAACATCCTTGTTTTTCAAAAAATTAAAGAGCCGATTGCGAAAGAGTTAGAA<br>CATATTCGAGCTGACTTTTCTGCGGGTGGGTACATTAAAAAAGATGAGCGGCTGGAAGACATCTTCAGT<br>CTAAACTATTATATCCACGTTCTGTCGCAGGCAGGCATTGAGAAATATAATGCGCTGATTGGTAAGATTG<br>TCACAGAAGGCGATGGTGAGATGAAAGGTCTTAATGAACATATCAATCTGTATAACCAGCAGCGTGGTC<br>GCGAAGACCGTCTTCCACTGTTCCGCCCACTGTATAAACAGATCCTGTCTGACCGGGAACAGCTGTCCTA<br>CCTGCCGGAAAGCTTTGAAAAGGATGAAGAGCTACTTCGCGCATTAAAGGAGTTTTACGACCATATTGC<br>GGAAGACATTTTGGGTAGAACGCAGCAACTGATGACGTCAATTTCTGAATACGATCTGAGTAGAATCTA<br>CGTTAGGAATGATAGCCAGCTGACCGATCATTAGCAAAAAAATGCTGGGCGACTGGAACGCTATCTATAT<br>GGCACGTGAACGTGCATATGATCATGAACAAGCACCGAAACGTATAACCGCGAAATATGAGCGTGATC<br>GCATTAAGGCGCTAAAGGGAGAAGAAGCATCTCACTCGCAAACCTGAACTCCTGTATCGCTTTCTTAG<br>ATAACGTGCGCGATTGTCGCGTCGACACGTATCTGTCAACCCTTGGGCAGAAAGAGGGTCCACATGGTC<br>TGTCTAACCTGGTGGAAAATGTCTTTGCGAGTTACCATGAAGCGGAACAACTGCTGTCTTTTCCATACCC<br>CGAAGAAAACAATCTAATACAGGATAAAGATAACGTGGTGTTAATCAAAAACCTGCTGGACAACATCA<br>GCGATCTGCAACGTTTCCTGAAACCTTTGTGGGGTATGGGTGACGAGCCAGACAAAGACGAACGTTTTT<br>ATGGTGAGTATAATTATATACGTGGCGCCCTTGACCAAGTTATTCCGCTGTATAACAAAGTACGGAACTA<br>TCTGACCCGTAAGCCATATTCTACCCGTAAAGTGAAACTGAACTTTGGCAACTCGCAACTGCTGTCGGGT<br>TGGGATCGTAACAAAGAAAAAGATAATAGTTGTGTTATCCTGCGTAAGGGACAAAATTTTTACCTCGCG<br>ATTATGAACAACAGACACAAGCGTTCATTTGAAAATAAGGTTCTGCCGGAGTATAAAGAGGGCGAACCG<br>TACTTCGAGAAAATGGATTATAAGTTCTTACCAGACCCTAATAAGATGTTACCGAAAGTCTTTCTTTCGA<br>AAAAAGGCATAGAAATCTATAAGCCGTCCCCGAAATTACTCGAACAGTATGGGCACGGGACCCACAAG<br>AAAGGGGATACTTTTAGCATGGACGATCTGCACGAACTGATCGATTTTTTTAAACACTCCATCGAAGCCC<br>ATGAAGACTGGAAACAGTTTGGGTTCAAGTTCTCTGATCAGCCACATACGAGAATGTGTCTAGTTTTTA<br>TCGGGAAGTGGAGGATCAGGGCTACAAACTTAGTTTTCGTAAAGTTTCAGAGAGTTATGTTTATAGTTTA<br>ATTGATCAGGGAAAACTTTACCTGTTCCAGATCTACAACAAAGATTTCTCGCCATGTAGTAAGGGTACCC<br>CGAATCTGCATACACTCTATTGGAGAATGTTATTCGATGAGCGTAACTTAGCGGATGTCATTTATAAATT<br>GGACGGGAAAGCAGAGATCTTTTTTCGTGAAAAATCACTGAAGAATGACCACCCGACTCATCCGGCCGG<br>GAAACCGATCAAAAAAAATCCCGCCAGAAAAAGGAGAAGAGTCTCTGTTTGAATATGATCTGGTGA<br>AAGACCGTCATTACACTATGGATAAATTTCAATTTCATGTTCCAATTACAATGAACTTCAAATGTTCGGC<br>GGGTTCAAAAGTAAATGATATGGTAAACGCCCATATTCGCGAAGCGAAAGATATGCATGTTATTGGCAT<br>CGATAGAGGCGAAAGAAACCTGCTTTATATTTGCGTAATTGACAGCCGTGGTACCATTCTGGACCAGAT<br>CTCTTTAAACACCATCAATGACATCGATTATCACGACCTGTTGGAGTCTCGGGACAAGGACCGCCAGCA<br>GGAGCGCCGTAATTGGCAGACAATTGAAGGCATAAAAGAATTAAAACAGGGTTACCTTTCCCAGGCCGT<br>ACACCGCATAGCGGAACTGATGGTGGCCTACAAAGCCGTGATTGCCCTGGAAGACTTGAATATGGGGTT<br>TAAACGTGGCCGTCAAAAAGTCGAGAGCAGCGTGTATCAGCAATTTGAAAAACAGTTGATTGACAAGTT<br>GAATTATTTGGTTGATAAAAAGAAACGTCCAGAAGATATTGGTGGCTTACTGCGTGCATACCAGTTTAC<br>GGCACCTTTTAAGTCCTTCAAAGAAATGGGTAAACAGAACGGGTTTCTGTTTTACATCCCGGCCTGGAAT<br>ACATCCAACATCGATCCTACCCACCGGGTTTGTCAACCTGTTTCATGCACAATATGAAAACGTGGATAAA<br>GCGAAGAGTTTTTTCCAAAAATTCGATAGTATTTCGTATAACCCAAAAAAAGATTGGTTTGAGTTTGCGT<br>TCGATTATAAAATTTTACTAAAAAGGCTGAGGGATCCCGCAGTATGTGGATCCTCTGCACCCATGGCA<br>GTCGTATTAAAAATTTTCGTAATTCGCAAAAGAATGGCCAGTGGGACTCGGAAGAGTTTGCCCTGACCG<br>AAGCGTTCAAATCGCTGTTTGTACGCTACGAAATTGACTACACAGCAGATCTGAAAACGACCATCGTCG<br>ATGAAAAACAGAAAGATTTTTTGTAGATCTCCTAAAACTGTTCAAACTGACTGTTCAGATGCGCAATTC<br>CTGGAAAGAGAAAGACCTGGATTATCTGATTAGCCCGGTAGCCGGTGCTGATGGACGATTTTTCGATAC<br>TCGTGAAGGTAACAAAAGTCTCCCGAAAGATGCTGATGCCAATGGTGCATACAATATTGCATTAAAGGG<br>GCTATGGGCCTTGCGACAGATCCGCCAGACCAGCGAAGGCGGCAAGCTGAAATTGGCCATATCGAATAA<br>GGAATGGTTACAATTTGTTCAGGAACGTAGCTATGAAAAAGATTGA |
| SEQ ID NO: 47 | ATGAACAACGGCACAAATAATTTTCAGAACTTCATCGGGATCTCAAGTTTGCAGAAAACGCTGCGCAAT<br>GCTCTGATCCCCACGGAAACCACGCAACAGTTCATCGTCAAGAACGGAATAATTAAAGAAGATGAGTTA<br>CGTGGCGAGAACCGCCAGATTCTGAAAGATATCATGGATGACTACTACCGCGGATTCATCTCTGAGACT<br>CTGAGTTCTATTGATGACATAGATTGGACTAGCCTGTTCGAAAAAATGGAAATTCAGCTGAAAAATGGT<br>GATAATAAAGATACCTTAATTAAGGAACAGACAGAGTATCGGAAAGCAATCCATAAAAAATTTGCGAA<br>CGACGATCGGTTTAAGAACATGTTTAGCGCCAAACTGATTAGTGACATATTACCTGAATTTGTCATCCAC<br>AACAATAATTATTCGGCATCAGAGAAAGAGGAAAAAAACCAGGTGATAAATCTGTTTTCGCGCTTTGCG<br>ACTAGCTTTAAAGATTACTTCAAGAACCGTGCAAATTGCTTTTCAGCGGACGATATTTCATCAAGCAGCT<br>GCCATCGCATCGTCAACGACAATGCAGAGATATTCTTTTCAAATGCGCTGGTCTACCGCCGGATCGTAAA<br>ATCGCTGAGCAATGACGATATCAACAAAATTTCGGGCGATATGAAAGATTCATTAAAAGAAATGAGTCT<br>GGAAGAAATATATTCTTACGAGAAGTATGGGAATTTATTACCCAGGAAGGCATTAGCTTCTATAATGA<br>TATCTGTGGGAAAGTGAATTCTTTTATGAACCTGTATTGTCAGAAAAATAAAGAAAACAAAATTTATA |

TABLE 5-continued

| SEQ ID NO | Sequence |
|---|---|
| | CAAACTTCAGAAACTTCACAAACAGATTCTATGCATTGCGGACACTAGCTATGAGGTCCCGTATAAATTT<br>GAAAGTGACGAGGAAGTGTACCAATCAGTTAACGGCTTCCTTGATAACATTAGCAGCAAACATATAGTC<br>GAAAGATTACGCAAAATCGGCGATAACTATAACGGCTACAACCTGGATAAAATTTATATCGTGTCCAAA<br>TTTTACGAGAGCGTTAGCCAAAAAACCTACCGCGACTGGGAACAATTAATACCGCCCTCGAAATTCAT<br>TACAATAATATCTTGCCGGGTAACGGTAAAAGTAAAGCCGACAAAGTAAAAAAAGCGGTTAAGAATGA<br>TTTACAGAAATCCATCACCGAAATAAATGAACTAGTGTCAAACTATAAGCTGTGCAGTGACGACAACAT<br>CAAAGCGGAGACTTATATACATGAGATTAGCCATATCTTGAATAACTTTGAAGCACAGGAATTGAAATA<br>CAATCCGGAAATTCACCTAGTTGAATCCGAGCTCAAAGCGAGTGAGCTTAAAAACGTGCTGGACGTGAT<br>CATGAATGCGTTTCATTGGTGTTCGGTTTTTATGACTGAGGAACTTGTTGATAAAGACAACAATTTTTAT<br>GCGGAACTGGAGGAGATTTACGATGAAATTTATCCAGTAATTAGTCTGTACAACCTGGTTCGTAACTAC<br>GTTACCCAGAAACCGTACAGCACGAAAAAGATTAAATTGAACTTTGGAATACCGACGTTAGCAGACGGT<br>TGGTCAAAGTCCAAGAGTATTCTAATAACGCTATCATACTGATGCGCGACAATCTGTATTATCTGGGCA<br>TCTTTAATGCGAAGAATAAACCGGACAAGAAGATTATCGAGGGTATACGTCAGAAAATAAGGGTGAC<br>TACAAAAGATGATTTATAATTTGCTCCCGGGTCCCAACAAAATGATCCCGAAAGTTTTCTTGAGCAGCA<br>AGACGGGGGTGGAAACGTATAAACCGAGCGCCTATATCCTAGAGGGGTATAAACAGAATAAACATATC<br>AAGTCTTCAAAAGACTTTGATATCACTTTCTGTCATGATCTGATCGACTACTTCAAAAACTGTATTGCAA<br>TTCATCCCGAGTGGAAAAACTTCGGTTTTGATTTTAGCGACACCAGTACTTATGAAGACATTTCCGGGTT<br>TTATCGTGAGGTAGAGTTACAAGGTTACAAGATTGATTGGACATACATTAGCGAAAAAGACATTGATCT<br>GCTGCAGGAAAAAGGTCAACTGTATCTGTTCCAGATATATAACAAAGATTTTTCGAAAAAATCAACCGG<br>GAATGACAACCTTCACACCATGTACCTGAAAAATCTTTTCTCAGAAGAAAATCTTAAGGATATCGTCCTG<br>AAACTTAACGGCGAAGCGGAAATCTTCTTCAGGAAGAGCAGCATAAAGAACCCAATCATTCATAAAAA<br>AGGCTCGATTTTAGTCAACCGTACCTACGAAGCAGAAGAAAAAGACCAGTTTGGCAACATTCAAATTGT<br>GCGTAAAAATATTCCGGAAACATTTATCAGGAGCTGTACAAATACTTCAACGATAAAAGCGACAAAGA<br>GCTGTCTGATGAAGCAGCCAAACTGAAGAATGTAGTGGGACACCACGAGGCAGCGACGAATATAGTCA<br>AGGACTATCGCTACACGTATGATAAATACTTCCTTCATATGCGTCCTATTACGATCAATTTCAAGCCAATAA<br>AACGGGTTTTATTAATGATAGGATCTTACAGTATATCGCTAAAGAAAAAGACTTACATGTGATCGGCATT<br>GATCGGGGCGAGCGTAACCTGATCTACGTGTCCGTGATTGATACTTGTGGTAATATAGTTGAACAGAAA<br>AGCTTTAACATTGTAAACGGCTACGACTATCAGATAAAACTGAAACAACAGGAGGGCGCTAGACAGATT<br>GCGCGGAAAGAATGGAAAGAAATTGGTAAAATTAAAGAGTAGAATTAACCCAAGCTAAAAATGCGACTACCTGAGCTTAGTAAT<br>CCACGAGATCTCTAAAATGGTAATCAAATACAATGCAATTATAGCGATGGAGGATTTGTCTTATGGTTTT<br>AAAAAAAGGGCGCTTTAAGGTCGAACGGCAAGTTTACCAGAAATTTGAAACCATGCTCATCAATAAACTC<br>AACTATCTGGTATTTAAAGATATTTCGATTACCGAGAATGGCGGTCTCCTGAAAGGTTATCAGCTGACAT<br>ACATTCCTGATAAACTTAAAAACGTGGGTCATCAGTGCGGCTGCATTTTTTATGTGCCTGCTGCATACAC<br>GAGCAAAATTGATCCGACCACCGGCTTTGTGAATATCTTTAAATTTAAAGACCTGACAGTGGACGCAAA<br>ACGTGAATTCATTAAAAAATTTGACTCAATTCGTTATGACAGTGAAAAAATCTGTTCTGCTTTACATTT<br>GACTACAATAACTTTATTACGCAAAACACGGTCATGAGCAAATCATCGTGGAGTGTGTATACATACGGC<br>GTGCGCATCAAACGTCGCTTTGTGAACGGCCGCTTCTCAAACGAAAGTGATACCATTGACATAACCAAA<br>GATATGGAGAAAACGTTGGAAATGACGGACATTAACTGGCGACATTCGTCAAGACATT<br>ATAGATTATGAAATTGTTCAGCACATATTCGAAATTTTCCGTTTAACAGTGCAAATGCGTAACTCCTTGT<br>CTGAACTGGAGGACCGTGATTACGATCGTCTCATTTCACCTGTACTGAACGAAAATAACATTTTTATGA<br>CAGCGCGAAAGCGGGGATGCACTTCCTAAGGATGCCGATGCAAATGGTGCGTATTGTATTGCATTAAA<br>AGGGTTATATGAAATTAAACAAATTACCGAAAATTGGAAGAAGATGGTAAATTTTCGCGCGATAAACT<br>CAAAATCAGCAATAAAGATTGGTTCGACTTTATCCGAATAAGCGCTATCTCTAA |
| SEQ ID NO: 48 | ATGACCAATAAATTCACTAACCAGTATTCTCTCTCTAAGACCCTGCGCTTTGAACTGATTCCGCAGGGGA<br>AAACCTTGGAGTTCATTCAAGAAAAAGGCCTCTTGTCTCAGGATAACACAGAGGCTGAATCTTACCAAG<br>AAATGAAGAAAACTATTGATAAGTTTCATAAATATTTCATTGATTTAGCCTTGTCTAACGCCAAATTAAC<br>TCACTTGGAAACGTATCTGGAGTTATACAACAAATCTGCCGAAACTAAGAAAGAACAGAAATTTAAGA<br>CGATTTGAAAAAGTACAGGACAATCTGCGTAAAGAAATTGTCAAATCCTTCAGTGACGGCGATGCTAA<br>AAGCATTTTTGCCATTCTGGACAAAAAAGAGTTGATTACTGCGAATTAGAAAAGTGGTTTGAAAACAA<br>TGAGCAGAAAGACATCTACTTCGATGAGAAATTCAAAACTTTCACCACCTATTTTACAGGATTTCATCAA<br>AACCGGAAGAACATGTACTCAGTAGAACCGAACTCCACGGCCATTGCGTATCGTTTGATCCATGAGAAT<br>CTGCCTAAATTTCTGGAGAATGCGAAAGCCTTTGAAAAGATTAAGCAGGTCGAATCGCTGCAAGTGAAT<br>TTTCGTGAACTCATGGGCGAATTTGGTGACGAAGGTCTAATCTTCGTTAACGAACTGGAAGAAATGTTTC<br>AGATTAATTACTACAATGACGTGCTATCGCAGAACGGTATCACAATCTACAATAGTATTATCTCAGGGTT<br>CACAAAAAACGATATAAAATACAAAGGCCTGAACGAGTATATCAATAACTACAACCAAACAAAGGACA<br>AAAAGGATAGGCTTCCGAAACTGAAGCAGTTATACAAACAGATTTTATCTGACAGAATCTCCCTGAGCT<br>TTCTGCCGGATGCTTTCACTGATGGGAAGCAGGTTCTGAAAGCGATTTTCGATTTTTATAAGATTAACTT<br>ACTGAGCTACACGATTGAAGGTCAAGAAGAATCTCAAAACTTACTGCTCTTGATCCGTCAAACCATTGA<br>AAATCTATCATCGTTCGATACGCAGAAAATCTACCTCAAAAACGATACTCACCTGACTACGATCTCTCAG<br>CAGGTTTTCGGGGATTTAGTGTATTTTCAACAGCTCTGAACTACTGGTATGAAACAAAGTCAATCCGA<br>AATTCGAGACGGAATATTCTAAGGCCAACGAAAAAAAACGTGAGATTCTTGATAAAGCTAAAGCCGTAT<br>TTACTAAACAGGATTACTTTTCTATTGCTTTCCTGCAGGAAGTTTTATCGGAGTATATCCTGACCCTGGAT<br>CATACATCTGATATCGTTAAAAAACACAGCAGCAATTGCATCGCTGACTATTTCAAAAACCACTTTGTCG<br>CCAAAAAAGAAAACGAAACAGACAAGACTTTCGATTTCATTGCTAACATCACCGCAAAATACCAGTGTA<br>TTCAGGGTATCTTGGAAAACGCCGACCAATACGAAGACGAACTGAAACAAGATCAGAAGCTGATCGAT<br>AATTTAAAATTCTTCTTAGATGCAATCTGGAGCTGTGCACTTCATCAAACCGCTTCATTTAAAGAGCG<br>AGTCCATTACCGAAAAGGACACCGCCTTCTATGACGTTTTTGAAAATTATTATGAAGCCCTCTCCTTGCT<br>GACTCCGCTGTATAATATGGTACGCAATTACGTAACCCAGAAACCATATTCTACCGAAAAAATTAAACT<br>GAACTTTGAAAACGCACAGCTGCTCAACGGTTGGGACGCGAATAAAGAAGGTGACTACCTCACCACCAT<br>CCTGAAAAAAGATGGTAACTATTTTCTGGCAATTATGGATAAAGGCTACATTCCAGAAATT<br>TCCTGAAGGGAAAGAAATTACGAAAAGATGGTGTACAAACTCTTACCTGGAGTTAACAAAATGTTGCC<br>GAAAGTATTTTTTAGTAATAAGAACATCGCGTACTTTAACCCGTCCAAAGAACTGCTGGAAATTATAA<br>AAAGGAGACGCATAAGAAAGGGGATACCTTTAACCTGGAACATTGCCATACCTTAATAGACTTCTTCAA<br>GGATTCCCTGAATAAACACGAGGATTGGAAATATTTCGATTTTCAGTTTAGTGAGACCAAGTCATACCA<br>GGATCTTAGCGGCTTTTATCGCGAAGTAGAACACCAAGGCTATAAAATTAACTTCAAAAACATCGACAG |

TABLE 5-continued

| SEQ ID NO | Sequence |
|---|---|
| | CGAATACATCGACGGTTTAGTTAACGAGGGCAAACTGTTTCTGTTCCAGATCTATTCAAAGGATTTTAGC<br>CCGTTCTCTAAAGGCAAACCAATATGCATACGTTGTACTGGAAAGCACTGTTTGAAGAGCAAAACCTG<br>CAGAATGTGATTTATAAACTGAACGGCCAAGCTGAGATTTTTTCCGTAAAGCCTCGATTAAACCGAAA<br>AATATCATCCTTCATAAGAAGAAAATAAAGATCGCTAAAAAACACTTCATAGATAAAAAAACCAAAAC<br>CTCCGAAATAGTGCCTGTTCAAACAATTAAGAACTTGAATATGTACTACCAGGGCAAGATATCGGAAAA<br>GGAGTTGACTCAAGACGATCTTCGCTATATCGATAACTTTTCGATTTTTAACGAAAAAAACAAGACGATC<br>GACATCATCAAAGATAAACGCTTCACTGTAGATAAGTTCCAGTTTCATGTGCCGATTACTATGAACTTCA<br>AAGCTACCGGGGGTAGCTATATCAACCAAACGGTGTTGGAATACCTGCAGAATAACCCGGAAGTCAAA<br>ATCATTGGGCTGGACCGCGGAGAACGTCACCTTGTGTACTTGACCTTAATCGATCAGCAAGGCAACATC<br>TTAAAACAAGAATCGCTGAATACCATTACGGATTCAAAGATTAGCACCCCGTATCATAAGCTGCTCGAT<br>AACAAGGAGAATGAGCGCGACCTGGCCCGTAAAAACTGGGGCACGGTGGAAAACATTAAGGAGTTAAA<br>GGAGGGTTATATTTCCCAGGTAGTGCATAAGATCGCCACTCTCATGCTCGAGGAAAATGCGATCGTTGTC<br>ATGGAAGACTTAAACTTCGGATTTAAACGTGGGCGATTTAAAGTAGAGAAACAAATCTACCAGAAGTTA<br>GAAAAAATGCTGATTGACAAATTAAATTACTTGGTCCTAAAAGACAAACAGCCGCAAGAATTGGGTGGA<br>TTATACAACGCCCTCCAACTTACCAATAAATTCGAAAGTTTTCAGAAAATGGGTAAACAGTCAGGCTTTC<br>TTTTTTATGTTCCTGCGTGGAACACATCCAAAATCGACCCTACAACCGGCTTCGTCAATTACTTCTATACT<br>AAATATGAAAACGTCGACAAAGCAAAAGCATTCTTTGAAAAGTTCGAAGCAATACGTTTTAACGCTGAG<br>AAAAAATATTTCGAGTTCGAAGTCAAGAAATACTCAGACTTTAACCCCAAAGCTGAGGGCACACAGCAA<br>GCGTGGACAATCTGCACCTACGGCGAGCGCATCGAAACGAAGCGTCAAAAGATCAGAATAACAAATT<br>TGTTTCAACACCTATCAACCTGACCGAGAAGATTGAAGACTTCTTAGGTAAAAATCAGATTGTTTATGGC<br>GACGGTAACTGTATAAAATCTCAAATAGCCTCAAAGGATGAAGAACATTTTTCGAAACATTATTATATT<br>GGTTCAAAATGACACTGCAGATGCGCAATAGTGAGACGCGTACAGATATTGATTATCTTATCAGCCCGG<br>TCATGAACGACAACGGTACTTTTTACAACTCCAGAGACTATGAAAACTTGAGAATCCAACTCTCCCCA<br>AAGATGCTGATGCGAACGGTGCTTATCACATCGCGAAAAAAGGTCTGATGCTGCTGAACAAAATCGACC<br>AAGCCGATCTGACTAAGAAAGTTGACCTAAGCATTTCAAATCGGGACTGGTTACAGTTTGTTCAAAAGA<br>ACAAATGA |
| SEQ ID NO: 49 | ATGGAACAGGAATATTATCTGGGCTTGGACATGGGCACCGGTTCCGTCGGCTGGGCTGTTACTGACAGT<br>GAATATCACGTTCTAAGAAAGCATGGTAAGGCATTGTGGGGTGTAAGACTTTTCGAATCTGCTTCCACTG<br>CTGAAGAGCGTAGAATGTTTAGAACGAGTCGACGTAGGCTAGACAGGCGCAATTGGAGAATCGAAATTT<br>TACAAGAAATTTTTGCGGAAGAGATATCTAAGAAAGACCCAGGCTTTTTCCTGAGAATGAAGGAATCTA<br>AGTATTACCCTGAGGATAAAAGAGATATAAATGGTAACTGTCCCGAATTGCCTTACGCATTATTTGTGGA<br>CGATGATTTTACCGATAAGGATTACCATAAAAAGTTCCCAACTATCTACCATTTACGCAAATGTTAATG<br>AATACAGAGGAAACCCCAGACATAAGCTAGTTTATCTGGCAATACACCATATGATGAAACATAGAGGC<br>CATTTCTTACTTTCCGGGGATATCAACGAAATCAAAGAGTTTGGTACCACATTTAGTAAGTTACTGGAAA<br>ACATAAAGAATGAAGAATTGGATTGGAACTTAGAACTCGGAAAAGAAGAATACGCGGTTGTCGAATCT<br>ATCCTGAAGGATAATATGCTGAATAGGTCGACCAAAAAAACTAGGCTGATCAAAGCACTGAAAGCCAA<br>ATCTATCTGCGAAAAAGCTGTTTTAAATTTACTTGCTGGTGGCACTGTTGAAGTTATCAGACATTTTTGGTT<br>TGGAAGAATTGAACGAAACCGAGCGTCCAAAAATTAGTTTCGCTGATAATGGCTACGATGATTACATTG<br>GTGAGGTGGAAAACGAGTTGGGCGAACAATTTTATATTATAGAGACAGCTAAGGCAGTCTATGACTGGG<br>CTGTTTTAGTAGAAATCCTTGGTAAATACACATCTATCTCCGAAGCGAAAGTTGCTACTTACGAAAAGCA<br>CAAGTCCGATCTCCAGTTTTTGAAGAAAATTGTCAGGAAATATCTGACTAAGGAAGAATATAAAGATAT<br>TTTCGTTAGTACCTCTGACAAACTGAAAAATTACTCCGCTTACATCGGGATGACCAAGATTAATGGCAAA<br>AAAGTTGATCTGCAAAGCAAAAGGTGTTCGAAGGAAGAATTTTATGATTTCATTAAAAAGAATGTCTTA<br>AAAAAATTAGAAGGTCAGCCAGAATACGAATATTTGAAAGAAGAACTGGAAAGAGAGACATTCTTACC<br>AAAACAAGTCAACAGAGATAATGGGGTAATTCCATATCAAATTCACCTCTACGAATTAAAAAAAATTTT<br>AGGCAATTTACGCGATAAAATTGACCTTATCAAAGAAAATGAGGATAAGCTGGTTCAACTCTTTGAATT<br>CAGAATACCCTATTATGTGGGCCCACTGAACAAGATTGATGACGGCAAAGAAGGTAAATTCACATGGGC<br>CGTCCGCAAATCCAATGAAAAAATTTACCCATGGAACTTTGAAAATGTAGTAGATATTGAAGCGTCTGC<br>GGAGAAATTTATTCGAAGAATGACTAATAAATGCACTTACTTGATGGGAAGGATGTTCTGCCTAAAGA<br>CAGCTTATTATACAGCAAGTACATGGTTCTAAACGAACTTAACAACGTTAAGTTGGACGGTGAGAAATT<br>AAGTGTAGAATTGAAACAAAGATTGTATACTGACGTCTTCTGCAAGTACAGAAAAGTGACAGTTAAAAA<br>AATTAAGAATTACTTGAAGTGCGAAGGTATAATTTCTGGAAACGTAGAGATTACTGGTATTGATGGTGA<br>TTTCAAAGCATCCCTAACAGCTTACCACGATTTCAAGGAAATCCTGACAGGAACTGAACTGCAAAAAA<br>AGATAAAGAAAACATTATTACTAATATTGTTCTTTTCGGTGATGACAAGAAATTGTTGAAGAAAAGACT<br>GAATAGACTTTACCCCCAGATTACTCCCAATCAACTTAAGAAAATTTGTGCTTTGTCTTACACAGGATGG<br>GGTCGTTTTTCAAAAAAGTTCTTAGAAGAGATTACCGCACCTGATCCAGAAACAGGCGAAGTATGGAAT<br>ATAATTACCGCCTTATGGGAATCGAACAATAATCTTATGCAACTTCTGAGCAATGAATATCGTTTCATGG<br>AAGAAGTTGAGACTTACAACATGGGCAAACAGACGAAGACTTTATCCTATGAAACTGTGGAAAATATGT<br>ATGTATCACCTTCTGTCAAGAGACAAATTTGGCAAACCTTAAAAATTGTCAAAGAATTAGAAAGGTAA<br>TGAAGGAGTCTCCTAAACGTGTGTTTATTGAAATGGCTAGAGAAAAACAAGAGTCAAAAGAACCGAG<br>TCAAGAAAGAAGCAGTTAATCGATTTATATAAGGCTTGTAAAAACGAAGAGAAAGATTGGGTTAAAGA<br>ATTGGGGGACCAAGAGGAACAAAAACTACGGTCGGATAAGTTGTATTTATACTATACGCAAAAGGGAC<br>GATGTATGTATTCCGGCGAGGTAATAGAATTGAAGGATTTATGGGACAATACAAAATATGACATAGACC<br>ATATATATCCCCAATCAAAACGATGGACGATAGCTTGAACAATAGAGTACTCGTGAAAAAAAAATATA<br>ATGCGACCAAATCTGATAAGTATCCTCTGAATGAAAATATCAGACATGAAAGAAGGGGTTCTGGAAGT<br>CCTTGTTAGATGGTGGGTTTATAAGCAAAGAAAAGTACGAGCGTCTAATAAGAAACACGGAGTTATCGC<br>CAGAAGAACTCGCTGGTTTATTGAGAGGCAAATCGTGGAAACGAGACAATCTACCAAAGCCGTTGCTG<br>AGATCCTAAAGCAAGTTTCCCAGAGTCGGAGATTGTCTATGTCAAAGCTGGCACAGTGAGCAGGTTTA<br>GGAAAGACTTCGAACTATTAAAGGTAAGAGAAGTGAACGATTTACATCACGCAAGGACGCTTACCTAA<br>ATATCGTTGTAGGTAACTCATATTATGTTAAATTTACCAAGAACGCTCTTGGTTTATAAAGGAGACCC<br>AGGTAGAACATATAACCTGAAAAAGATGTTCACCTCTGGTTGGAATATTGAGAGAAACGGAGAAGTCGC<br>ATGGGAAGTTGGTAAGAAAGGGACTATAGTGACAGTAAAGCAAATTATGACAAAATAATATCCTCG<br>TTACAAGGCAGGTTCATGAAGCAAAGGGCGGCCTTTTTGACCAACAATTATGAAGAAAGGGAAAGGT<br>CAAATTGCAATAAAAGAAACCGATGAGAGACTAGCGTCAATAGAAAAGTATGGTGGCTATAATAAAGC<br>TGCGGGTGCATACTTTATGCTTGTTGAATCAAAAGACAAGAAAGGTAAGACTATTAGAACTATAGAATT |

TABLE 5-continued

| SEQ ID NO | Sequence |
|---|---|
| | TATACCCCTGTACCTTAAAAACAAAATTGAATCGGATGAGTCAATCGCGTTAAATTTTCTAGAGAAAGG<br>AAGGGGTTTAAAAGAACCAAAGATCCTGTTAAAAAAGATTAAGATTGACACCTTGTTCGATGTAGATGG<br>ATTTAAAATGTGGTTATCTGGCAGAACAGGCGATAGACTTTTGTTTAAGTGCGCTAATCAATTAATTTTG<br>GATGAGAAATCATTGTCACAATGAAAAAAATAGTTAAGTTTATTCAGAGAAGACAAGAAAACAGGGA<br>GTTGAAATTATCTGATAAAGATGGTATCGACAATGAAGTTTTAATGGAAATTCTACAATACATTCGTTGAT<br>AAACTTGAAAATACCGTATATCGAATCAGGTTAAGTGAACAAGCCAAAACATTAATTGATAAACAAAAA<br>GAATTTGAAAGGCTATCACTGGAAGACAAATCCTCCACCCTATTTGAAATTTTGCATATATTCCAGTGCC<br>AATCTTCAGCAGCTAATTTAAAAATGATTGGCGGACCTGGGAAAGCCGGCATCCTAGTGATGAACAATA<br>ATATCTCCAAGTGTAACAAAATATCAATTATTAACCAATCTCCGACAGGTATTTTTGAAAATGAAATAGA<br>CTTGCTTAAGATATAA |
| SEQ ID NO: 50 | ATGTCTTTCGACTCTTTCACCAACCTGTACTCTCTGTCTAAAACCCTGAAATTCGAAATGCGTCCGGTTGG<br>TAACACCCAGAAAATGCTGGACAACGCGGGTGTTTTCGAAAAAGACAAACTGATCCAGAAAAAATACG<br>GTAAAACCAAACCGTACTTCGACCGTCTGCACCGTGAATTCATCGAAGAAGCGCTGACCGGTGTTGAAC<br>TGATCGGTCTGGACGAAAACTTCCGTACCCTGGTTGACTGGCAGAAAGACAAAAAAACAACGTTGCGA<br>TGAAAGCGTACGAAAACTCTCTGCAGCGTCTGCGTACCGAAATCGGTAAAATCTTCAACCTGAAAGCGG<br>AAGACTGGGTTAAAAACAAATACCCGATCCTGGGTCTGAAAAACAAAACTCCGACATCCTGTTCGAAG<br>AAGCGGTTTTCGGTATCCTGAAAGCGCGTTACGGTGAAGAAAAAGACACCTTCATCGAAGTTGAAGAAA<br>TCGACAAAACCGGTAAATCTAAAATCAACCAGATCTCTATCTTCGACTCTTGGAAAGGTTTCACCGGTTA<br>CTTCAAAAAATTCTTCGAAACCCGTAAAAACTTCTACAAAAACGACGGTACCTCTACCGCGATCGCGAC<br>CCGTATCATCGACCAGAACCTGAACGTTTCATCGACAACCTGTCTATCGTTGAATCTGTTCGTCAGAAA<br>GTTGACCTGGCGGAAACCGAAAAATCTTTCTCTATCTCTCTGTCTCAGTTCTTCTCTATCGACTTCTACAA<br>CAAATGCCTGCTGCAGGACGGTATCGACTACTACAACAAAATCATCGGTGGTGAAACCCTGAAAACGG<br>TGAAAAACTGATCGGTCTGAACGAACTGATCAACCAGTACCGTCAGAACAACAAAGACCAGAAAATCC<br>CGTTCTTCAAACTGCTGGACAAACAGATCCTGTCTGAAAAAATCTACTACCTGGGTCTGATCACCAAAGG<br>ACACCGAACTGATCGAAGCGCTGTCTCAGTTCGCGAAAACCGCGGAAGAAAAACCAAAATCGTTAAA<br>AAACTGTTCGCGGACTTCGTTGAAAACAACTCTAAATACGACCTGGCGCAGATCTACATCTCTCAGGAA<br>GCGTTCAACACCATCTCTAACAAATGGACCTCTGAAACCGAAACCTTCGCGAAATACCTGTTCGAAGCG<br>ATGAAATCTGGTAAACTGGCGAAATACGAAAAAAAAGCAACTCTTACAAATTCCCGGACTTCATCGCG<br>CTGTCTCAGATGAAATCTGCGCTGCTGTCTATCTCTCTGGAAGGTCACTTCTGGAAAGAAAAATACTACA<br>AAATCTCTAAATTCCAGGAAAAAACCAACTGGGAACAGTTCCTGGCGATCTTCCTGTACGAATTCAACT<br>CTCTGTTCTCTGACAAAATCAACACCAAAGACGGTGAAACCAAACAGGTTGGTTACTACCTGTTCGCGA<br>AGACCTGCACAACCTGATCCTGTCTGAACAGATCGACATCCCGAAAGACTCTAAAGTTACCATCAAAG<br>ACTTCGACTCTGTTCTGACCATCTACCAGATGGCGAAATACTTCGCGGTTGAAAAAAAACGTGCGT<br>GGCTGGCGGAATACGAACTGGACTCTTTCTACACCCAGCCGGACACCGGTTACCTGCAGTTCTACGACA<br>ACGCGTACGAAGACATCGTTCAGGTTTACAAACAAACTGCGTAACTACCTGACCAAAAAACCGTACTCTG<br>AAGAAAAATGGAAACTGAACTTCGAAAACTCTACCCTGGCGAACGGTTGGGACAAAAACAAAGAATCT<br>GACAACTCTGCGGTTATCCTGCAGAAAGGTGGTAAATACTACCTGGGTCTGATCACCAAAGGTCACAAC<br>AAAATCTTCGACGACCGTTTCCAGGAAAAATTCATCGTTGGTATCGAAGGTGGTAAATACGAAAAAATC<br>GTTTACAAATTCTTCCCGGACCAGGCGAAATGTTCCCGAAAGTTTGCTTCTCTGCGAAAGGTCTGGAAT<br>CTTCCGTCCGTCTGAAGAAATCCTGCGTATCTACAACAACGCGGAATTCAAAAAAGGTGAAACCTACT<br>CTATCGACTCTATGCAGAAACTGATCGACTTCTACAAAGACTGCCTGACCAAATACGAAGGTTGGGCGT<br>GCTACACCTTCCGTCACCTGAAACCGACCGAAGAATACCAGAACAACATCGGTGAATTCTTCCGTGACG<br>TTGCGGAAGACGGTTACCGTATCGACTTCCAGGGTATCTCTGACCAGTACATCCACGAAAAAAACGAAA<br>AAGGTGAACTGCACCTGTTCGAAATCCACAACAAAGACTGGAACCTGGACAAAGCGCGTGACGGTAAA<br>TCTAAAACCACCCAGAAAAACCTGCACACCCTGTACTTCGAATCTCTGTTCTCTAACGACAACGTTGTTC<br>AGAACTTCCCGATCAAACTGAACGGTCAGGCGGAAATCTTCTACCGTCCGAAAACCGAAAAAGACAAA<br>CTGGAATCTAAAAAAGACAAAAAAGGTAACAAAGTTATCGACCACAAACGTTACTCTGAAAACAAAAT<br>CTTCTTCCACGTTCCGCTGACCCTGAACCGTACCAAAAACGACTCTTACCGTTTCAACGCGCAGATCAAC<br>AACTTCCTGGCGAACAACAAAGACATCAACATCATCGGTGTTGACCGTGGTGAAAAACACCTGGTTTAC<br>TACTCTGTTATCACCCAGGCGTCTGACATCCTGGAATCTGGTTCTCTGAACGAACTGAACGGTGTTAACT<br>ACGCGGAAAAACTGGGTAAAAAGCGGAAAACCGTGAACAGGCGCGTCGTGACTGGCAGGACGTTCAG<br>GGTATCAAAGACCTGAAAAAAGGTTACATCTCTCAGGTTGTTCGTAAACTGGCGGACCTGGCGATCAAA<br>CACGCGCGATCATCATCCTGGAAGACCTGAACATGCGTTTCAAACAGGTTCGTGGTGGTATCGAAAAA<br>TCTATCTACCAGCAGCTGGAAAAAGCGCTGATCGACAAACTGTCTTTCCTGGTTGACAAAGGTGAAAAA<br>AACCCGGAACAGGCGGGTCACCTGCTGAAAGCGTACCAGCTGTCTGCGCCGTTCGAAACCTTCCAGAAA<br>ATGGGTAAACAGACCGGTATCATCTTCTACACCCAGGCGTCTTACACCTCTAAATCTGACCCGGTTACCG<br>GTTGGCGTCCGCACCTGTACCTGAAATACTTCTCTGCGAAAAAAGCGAAAGACGACATCGCGAAATTCA<br>CCAAAATCGAATTCGTTAACGACCGTTTCGAACTGACCTACGACATCAAAGACTTCCAGCAGGCGAAG<br>AATACCCGAACAAAACCGTTTGGAAAGTTTGCTCTAACGTTGAACGTTTCCGTTGGGACAAAAACCTGA<br>ACCAGAACAAAGGTGGTTACACCCACTCACCAACATCACCGAAAACATCCAGGAACTGTTCACCCAAAT<br>ACGGTATCGACATCACCAAAGACCTGCTGACCCAGATCTCTACCATCGACGAAAAACAGAACACCTCTT<br>TCTTCCGTGACTTCATCTTCTACTTCAACCTGATCTGCCAGATCCGTAACCACCGACGACTCTGAAATCGC<br>GAAAAAAAACGGTAAAGACGACTTCATCCTGTCTCCGGTTGAACCGTTCTTCGACTCTCGTAAAGACAA<br>CGGTAACAAACTGCCGGAAAACGGTGACGACAACGGTGCGTACAACATCGCGCGTAAAGGTATCGTTAT<br>CCTGAACAAAATCTCTCAGTACTCTGAAAAAACGAAAACTGCGAAAAAATGAAATGGGGTGACCTGT<br>ACGTTTCTAACATCGACTGGGACAACTTCGTT |
| SEQ ID NO: 51 | ATGGAAAACTTTAAAAACTTATACCCAATAAACAAAACGTTACGTTTTGAACTGCGTCCATATGGTAAA<br>ACACTGGAAAACTTTAAAAAAGCGGTTTGTTGGAGAAGGATGCATTTAAAGCGAACTCTCGCAGATCC<br>ATGCAGGCCATCATTGATGAAAAATTTAAAGAGACGATTCGAAGAACGTGTCGAAATACACGGATTTAGT<br>GAGTGTGACTTAGGTAATATGACTTCTAAAGATAAGAAAATCACCGATAAGGCGGCGACCAACCTGAAG<br>AAGCAAGTCATTTATCTTTTGATGATGAAACTTTAACAACTATTTGAAACCGGACAAAACATCGATG<br>CCTTATTTAAAAATGACCCTTCGAACCCGGTGATTAGCACATTTAAGGGCTTCACAACGTATTTTGTCAA<br>TTTTTTTGAAATTCGTAAACATATCTTCAAAGGAGAATCAAGCGGCTCTATGGCTTATCGCATTATTGAT<br>GAAAACCCTGACGACCTATTTGAATAACATTGAAAAAATCAAAAAAACTGCCAGAGGAATTAAAGTCTCAG |

TABLE 5-continued

| SEQ ID NO | Sequence |
|---|---|
| | TTAGAAGGCATCGACCAGATCGACAAACTCAACAACTATAACGAATTTATTACGCAGTCTGGTATCACC<br>CACTATAATGAAATTATTGGAGGTATCAGTAAATCAGAAAATGTGAAAATCCAAGGGATTAATGAAGGC<br>ATTAACCTCTATTGCCAGAAAAATAAAGTGAAACTGCCGAGGCTGACTCCACTCTACAAAATGATCCTG<br>TCTGACCGCGTCTCGAATAGCTTTGTCCTGGACACAATTGAAAACGATACGGAATTGATTGAGATGATA<br>AGCGATCTGATTAACAAAACCGAAATTTCACAGGATGTAATCATGAGTGATATACAAAACATCTTTATT<br>AAATATAAACAGCTTGGTAATCTGCCTGGAATTAGCTATTCGTCAATAGTGAACGCAATCTGTTCTGATT<br>ATGATAACAATTTTGGCGACGGTAAGCGTAAAAAGAGTTATGAAAACGATAGGAAAAAACACCTGGAA<br>ACTAACGTGTATTCTATCAACTATATCAGCGAACTGCTTACGGACACCGATGTGAGTTCAAACATTAAGA<br>TGCGGTATAAGGAGCTTGAACAGAACTACCAGGTCTGTAAGGAAAACTTCAACGCAACCAACTGGATGA<br>ACATTAAAAATATCAAACAATCCGAGAAGACCAACTTAATCAAAGATCTGCTGGATATTTTGAAGAGCA<br>TTCAACGTTTTTATGATCTGTTCGATATCGTTGATGAAGACAAGAATCCTAGTGCGGAATTTTATACATG<br>GCTGTCTAAAAATGCGGAGAAATTGGATTTCGAATTCAATTCTGTTTATAATAAATCACGCAACTATTTG<br>ACCCGCAAACAATACAGCGACAAAAAGATAAAACTAAACTTCGACAGTCCGACATTGGCAAAGGGCTG<br>GGACGCAAATAAGGAAATCGATAACTCTACGATAATTATGCGTAAGTTCAATAATGATCGAGGTGATTA<br>TGATTATTCTTAGGCATTTGGAACAAAAGCACCCCGGCCAACGAAAAGATAATTCCACTGGAGGATAA<br>CGGTCTGTTCGAAAAAATGCAGTACAAATTATATCCGGATCCAAGCAAGATGCTTCCAAAGCAGTTTCT<br>GTCTAAAATTTGGAAAGCTAAGCATCCGACCACCCCAGAATTTGACAAGAAATATAAGGAAGGCCGCCA<br>TAAGAAAGGTCCCGATTTTGAAAAAGAATTCTTGCACGAACTGATTGATTGCTTTAAACATGGCTTAGTC<br>AATCACGATGAAAAGTATCAAGATGTTTTTGGATTCAATTTGAGAAACACAGAAGACTACAATTCCTAC<br>ACTGAGTTTCTCGAAGATGTGGAACGATGTAATTATAATCTGAGCTTTAACAAAATCGCGGACACCTCG<br>AATCTGATTAACGATGGTAAACTTTATGTTTTCCAGATCTGGAGCAAGGATTTTCTCTATTGACAGCAAAG<br>GCACCAAAAACCTGAACACCATTTACTTTGAAAGTCTCTTCAGCGAAGAAAATATGATTGAGAAAATGT<br>TTAAACTTAGCGGTGAAGCTGAAATATTCTATCGCCCGGCAAGCCTGAACTATTGCGAAGACATTATCA<br>AAAAGGGTCATCACCACGCTGAACTGAAAGATAAATTTGATTATCCTATCATAAAAGATAAACGCTATA<br>GCCAGGATAAATTTTTTTTTCATGTTCCTATGGTCATTAACTACAAATCAGAAAAACTGAACTCTAAAAG<br>CCTCAATAATCGAACCAATGAAAACCTTGGGCAGTTTACCCATATAATTGGAATTGATCGCGGAGAGCG<br>TCATTTAATCTACCTGACCGTAGTCGATGTATCGACCGGCGAGATCGTCGAGCAGAAGCACTTAGACGA<br>GATTATCAACACTGATACCAAAGGTGTTGAGCATAAGACGCACTATCTAAACAAGCTGGAGGAAAAATC<br>GAAAACCCGTGATAATGAACGTAAGAGTTGGGAGGCAATTGAAACGATTAAAGAACTGAAGGAGGGTT<br>ATATCAGCCACGTAATCAATGAAATTCAAAAACTGCAGGAAAAATACAACGCCCTGATCGTTATGGAAA<br>ATCTGAATTACGGTTTCAAAAATTCTCGCATCAAAGTGGAAAAACAGGTATATCAGAAGTTCGAGACGG<br>CATTAATTAAAAGTTTAATTACATCATTGACAAAAAAGATCCGGAAACTTATATTCATGGCTATCAGCT<br>GACGAACCCGATCACCACACTGGATAAAATTGGTAACCAGTCTGGTATCGTGCTTTACATCCCTGCCTGG<br>AATACCAGTAAAATCGATCCGGTAACGGGATTCGTCAACCTTCTATATGCAGATGACCTCAAATATAAG<br>AATCAGGAACAGGCCAAGTCTTTTATTCAGAAAATCGATAACATTTACTTTGAGAATGGGGAATTCAAA<br>TTTGATATTGATTTTCTAAATGGAACAATCGTTATAGTATATCTAAGACGAAATGGACGCTCACCTCGT<br>ACGGAACCCGAATCCAGACATTCCGCAATCCGCAGAAGAACAATAAATGGGACAGCGCCGAGTATGAT<br>CTCACTGAAGAATTCAAATTGATTCTGAACATTGACGGTACCTCTGAAAAGCCAGGATGTCGAAACCTAT<br>AAAAAATTTATGTCTCTGTTCAAGCTGATGCTGCAACTTAGGAACTCTGTTACCGGCACTGATATCGATT<br>ATATGATCTCCCCTGTCACTGATAAAACAGGTACGCATTTCGATTCGCGCGAAAATATCAAAAATCTGCC<br>CGCAGATGCCGACGCCAATGGGGCGTACAATATTGCACGCAAGGGTATCATGGCGATCGAAAACATTAT<br>GAATGGTATCAGCGACCCGCTGAAAATCTCAAACGAAGATTATTTGAAATATATCCAAAACCAGCAGGA<br>ATAA |
| SEQ ID NO: 52 | ATGACCCAGTTCGAAGGTTTCACCAACCTGTACCAGGTTTCTAAAACCCTGCGTTTCGAACTGATCCCGC<br>AGGGTAAAACCCTGAAACACATCCAGGAACAGGGTTTCATCGAAGAAGACAAAGCGCGTAACGACCAC<br>TACAAAGAACTGAAACCGATCATCGACCGTATCTACAAAACCTACGCGGACCAGTGCCTGCAGCTGGTT<br>CAGCTGGACTGGGAAAACCTGTCTGCGGCGATCGACTCTTACCGTAAAGAAAAACCGAAGAAACCCGT<br>AACGCGCTGATCGAAGAACAGGCGACCTACCGTAACGCGATCCACGACTACTTCATCGGTCGTACCGAC<br>AACCTGACCGACGCGATCAACAAACGTCACGCGGAAATCTACAAAGGTCTGTTCAAAGCGGAACTGTTC<br>AACGGTAAAGTTCTGAAACAGCTGGGTACCGTTACCACCACCGAACACGAAAACGCGCTGCTGCGTTCT<br>TTCGACAAATTCACCACCTACTTCTCTGGTTTCTACGAAAACCGTAAAAACGTTTTCTCTGCGGAAGACA<br>TCTCTACCGCGATCCCGCACCGTATCGTTCAGGACAACTTCCCGAAATTCAAAGAAAACTGCCACATCTT<br>CACCCGTCTGATCACCGCGGTTCCGTCTCTGCGTGAACACTTCGAAAACGTTAAAAAAGCGATCGGTATC<br>TTCGTTTCTACCTCTATCGAAGAAGTTTTCTCTTTCCCGTTCTACAACCAGCTGCTGACCCAGACCCAGAT<br>CGACCTGTACAACCAGCTGCTGGGTGGTATCTCTCGTGAAGCGGGTACCGAAAAATCAAAGGTCTGAA<br>CGAAGTTCTGAACCTGGCGATCCAGAAAAACGACGAAACCGCGCACATCATCGCGTCTCTGCCGCACCG<br>TTTCATCCCGCTGTTCAAACAGATCCTGTCTGACCGTAACACCGCCCTGTCTTTCATCCTGGAAGAATTCAAA<br>TCTGACGAAGAAGTTATCCAGTCTTTCTGCAAATACAAAACCTGCGCGTAACGAAAACGTTCTGGAA<br>ACCGCGGAAGCGCTGTTCAACGAACTGAACTCTATCGACCTGACCCACATCTTCATCTCTCACAAAAAA<br>CTGGAAACCATCTCTTCTGCGCTGTGCGACCACTGGGACACCCTGCGTAACGCGCTGTACAACGTCGTA<br>TCTCTGAACTGACCGGTAAAATCACCAAATCTGCGAAAGAAAAAGTTCAGCGTTCTCTGAAACACGAAG<br>ACATCAACCTGCAGGAAATCATCTCTGCGGCGGGTAAAGAACTGTCTGAAGCGTTCAAACAAAGCCCT<br>CTGAAATCCTGTCTCACGCGCACGCGGCGCTGGACCAGCCGCTGCCGACCACCCTGAAAAAACAGGAAG<br>AAAAAGAAATCCTGAAATCTCAGCTGGACTCTCTGCTGGGTCTGTACCACCTGCTGGACTGGTTCGCGGT<br>TGACGAATCTAACGAAGTTGACCCGGAATTCTCTGCGCGTCTGACCGGTATCAAACTGGAAATGGAACC<br>GTCTCTGTCTTTCTACAACAAAGCGCGTAACTACGCGACCAAAAAACCGTACTCTGTTGAAAAATTCAA<br>ACTGAACTTCCAGATGCCGACCCTGGCGTCTGGTTGGGACGTTAACAAAGAAAAAAACAACGGTGCGAT<br>CCTGTTCGTTAAAAACGGTCTGTACTACCTGGGTATCATGCCGAAACAGAAGGTCGTTACAAAGCGCT<br>GTCTTTCGAACCGACCGAAAAAACCTCTGAAGGTTTCGACAAAATGTACTACGACTACTTCCCGGACGC<br>GGCGAAAATGATCCCGAAGTCTACCAGCTGAAAGCGGTTACCGCGCTTCCGACCCCACACCAC<br>CCCGATCCTGCTGTCTAACAACTTCATCGAACCGCTGGAAATCACCAAAGAAATCTACGACCTGAACAA<br>CCCGGAAAAGAACCGAAAAATTCCAGACCGCGTACGCGAAAAAAACCGGTGACCAGAAAGGTTACC<br>GTGAAGCGCTGTGCAAATGGATCGACTTCACCCGTGACTTCCTGTCTAAATACACCAAAACCACCTCTAT<br>CGACCTGTCTTCTCTGCGTCCGTCTTCTCAGTACAAAGACCTGGGTGAATACTACGCGGAACTGAACCCG<br>CTGCTGTACCACATCTCTTTCCAGCGTATCGCGGAAAAAGAAATCATGGACGCGGTTGAAACCGGTAAA |

TABLE 5-continued

| SEQ ID NO | Sequence |
|---|---|
| | CTGTACCTGTTCCAGATCTACAACAAAGACTTCGCGAAAGGTCACCACGGTAAACCGAACCTGCACACC<br>CTGTACTGGACCGGTCTGTTCTCTCCGGAAAACCTGGCGAAAACCTCTATCAAACTGAACGGTCAGGCG<br>GAACTGTTCTACCGTCCGAAATCTCGTATGAAACGTATGGCGCACCGTCTGGGTGAAAAATGCTGAAC<br>AAAAAACTGAAAGACCAGAAAACCCCGATCCCGGACACCCGTTGTACCAGGAACTGTACGACTACGTTAA<br>CCACCGTCTGTCTCACGACCTGTCTGACGAAGCGCGTGCGCTGCTGCCGAACGTTATCACCAAAGAAGTT<br>TCTCACGAAATCATCAAAGACCGTCGTTTCACCTCTGACAAATTCTTCTTCCACGTTCCGATCACCCTGA<br>ACTACCAGGCGGCGAACTCTCCGTCTAAATTCAACCAGCGTGTTAACGCGTACCTGAAAGAACACCCGG<br>AAACCCCGATCATCGGTATCGACCGTGGTGAACGTAACCTGACTTCTACATCACCGTTATCGACTCTACCGG<br>TAAAATCCTGGAACAGCGTTCTCTGAACACCATCCAGCAGTTCGACTACCAGAAAAAACTGGACAACCG<br>TGAAAAAGAACGTGTTGCGGCGCGTCAGGCGTGGTCTGTTGTTGGTACCATCAAAGACCTGAAACAGGG<br>TTACCTGTCTCAGGTTATCCACGAAATCGTTGACCTGATGATCCACTACCAGGCGGTTGTTGTTCTGGAA<br>AACCTGAACTTCGGTTTCAAATCTAAACGTACCGGTATCGCGGAAAAAGCGGTTTACCAGCAGTTCGAA<br>AAAATGCTGATCGACAAACTGAACTGCCTGGTTCTGAAAGACTACCCGGCGGAAAAAGTTGGTGGTGTT<br>CTGAACCCGTACCAGCTGACCGACCAGTTCACCTCTTTCGCGAAAATGGGTACCCAGTCTGGTTTCCTGT<br>TCTACGTTCCGGCGCCGTACACCTCTAAAATCGACCCGCTGACCGGTTTCGTTGACCCGTTCGTTTGGAA<br>AACCATCAAAACCACGAATCTCGTAAACACTTCCTGGAAGGTTTCGACTTCCTGCACTACGACGTTAA<br>AACCGGTGACTTCATCCTGCACTTCAAAATGAACCGTAACCTGTCTTTCCAGCGTGGTCTGCCGGGTTTC<br>ATGCCGGCGTGGGACATCGTTTTCGAAAAAAACGAAACCCAGTTCGACGCGAAAGGTACCCCGTTCATC<br>GCGGGTAAACGTATCGTTCCGGTTATCGAAAACCACCGTTTCACCGGTCGTTACCGTGACCTGTACCCGG<br>CGAACGAACTGATCGCGCTGCTGGAAGAAAAAGGTATCGTTTTCCGTGACGGTTCTAACATCCTGCCGA<br>AACTGCTGGAAAACGACGACTCTCACGCGATCGACACCATGGTTGCGCCGTCGATCCGTTCTGTTCTGCAGAT<br>GCGTAACTCTAACGCGGCGACCGGTGAAGACTACATCAACTCTCCGGTTCGTGACCTGAACGGTGTTTG<br>CTTCGACTCTCGTTTCCAGAACCCGGAATGGCCGATGGACGCGGACGCGAACGGTGCGTACCACATCGC<br>GCTGAAAGGTCAGCTGCTGCTGAACCACCTGAAAGAATCTAAAGACCTGAAACTGCAGAACGGTATCTC<br>TAACCAGGACTGGCTGGCGTACATCCAGGAACTGCGTAACTA |
| SEQ ID NO: 53 | ATGGCGGTTAAATCTATCAAAGTTAAACTGCGTCTGGACGACATGCCGGAAATCCGTGCGGGTCTGTGG<br>AAACTGCACAAAGAAGTTAACGCGGGTGTTCGTTACTACACCGAATGGCTGTCTCTGCTGCGTCAGGAA<br>AACCTGTACCGTCGTTCTCCGAACGGTGACGGTGAACAGGAATGCGACAAAACCGCGGAAGAATGCAA<br>AGCGGAACTGCTGGAACGTCTGCGTGCGCGTCAGGTGAAACGGTCACCGTGGTCCGGCGGGTTCTGA<br>CGACGAACTGCTGCAGCTGGCGCGTCAGCTGTACGAACTGCTGGTTCCGCAGGCGATCGGTGCGAAAGG<br>TGACGCGCAGCAGATCGCGCGTAAATTCCTGTCTCCGCTGGCGGACAAAGACGCGGTTGGTGGTCTGGG<br>TATCGCGAAAGCGGGTAACAAACCGCGTTGGGTTCGTATGCGTGAAGCGGGTGAACGGGTTGGGAAG<br>AAGAAAAAGAAAAAGCGGAAACCCGTAAATCTGCGGACCGTACGCGCGACGTTCTGCGTGCGCTGGCG<br>GACTTCGGTCTGAAACCGCTGATGCGTGTTTACACCGACTCTGAAATGTCTTCTGTTGAATGGAAACCGC<br>TGCGTAAAGGTCAGGCGGTTCGTACCTGGGACCGTGACATGTTCCAGCAGGCGATCGAACGTATGATGT<br>CTTGGGAATCTTGGAACCAGCGTGTTGGTCAGGAATACGCGAAACTGGTTGAACAGAAAAACCGTTTCG<br>AACAGAAAAACTTCGTTGGTCAGGAACACCTGGTTCACCTGGTTAACCAGCTGCAGCAGGACATGAAAG<br>AAGCGTCTCCGGGTCTGGAATCTAAAGAACAGACCGCGCACTACGTTACCGGTCGTGCGCTGCGTGGTT<br>CTGACAAAGTTTTCGAAAATGGGGTAAACTGGCGCCGGACGCGCCGTTCGACCTGTACGACGCGGAAA<br>TCAAAAACGTTCAGCGTCGTAACACCCGTCGTTTCGGTTCTCACGACCTGTTCGCGAAACTGGCGGAACC<br>GGAATACCAGGCGCTGTGGCGTGAAGACGCGTCTTTCCTGCGCCGGTTTACAACTCTATCCTG<br>CGTAAACTGAACCACGCGAAATGTTCGCGACCTTCACCCTGCCGGACGCGACCGCGCACCCGATCTGG<br>ACCCGTTTCGACAAACTGGGTGGTAACCTGCACCAGTACACCTTCCTGTTCAACGAATTCGGTGAACGTC<br>GTCACGCGATCCGTTTCCACAAACTGCTGAAAGTTGAAAACGGTGTTGCGCGTGAAGTTGACGACGTTA<br>CCGTTCCGATCTCTATGTCTGAACAGCTGGACAACCTGCTGCCGCGTGACCCGAACGAACCGATCGCGCT<br>GTACTTCCGTGACTACGGTGCGGAACAGCACTTCACCGGTGAATTCGGTGGTGCGAAAATCCAGTGCCG<br>TCGTGACCAGCTGGCGCACATGCACCGTCGTCGTGGTGCGCGTGACGTTTACCTGAACGTTTCTGTTCGT<br>GTTCAGTCTCAGTCTGAAGCGCGTGGTAACGTCGTCCGCCGTACGCGGCGGTTTTCCGTCTGGTTGGTG<br>ACAACCACCGTGCGTTCGTTCACTTCGACAAACTGTCTGACTACCTGCTGGCGGAACACCCGGACGACGGTA<br>AACTGGGTTCTGAAGGTCTGCTGTCTGGTCTGCGTGTTATGTCTGTTGACCTGGGTCTGCGTACCTCTGCG<br>TCTATCTCTGTTTTCCGTGTTGCGCGTAAAGACGAACTGAAACCGAACTCTAAAGGTCGTGTTCCGTTCT<br>TCTTCCCGATCAAAGGTAACGACAACCTGGTTGCGGTTCACGAACGTTCTCAGCTGCTGAAACTGCCGG<br>GTGAAACCGAATCTAAAGACCTGCGTGCGATCCGTGAAGAACGTCAGCGTACCCTGCGTCAGCTGCGTA<br>CCCAGCTGGCGTACCTGCGTCTGCTGGTTCGTTGCGGTTCTGAAGACGTTGGTCGTCGTGAACGTTCTTG<br>GGCGAAACTGATCGAACAGCGGTTGACGCGGCGAACCACATGACCCCGGACTGGCGTGAAGCGTTCG<br>AAAACGAACTGCAGAAACTGAAATCTCTGCACGGTATCTGCTCTGACAAAGAATGGATGGACGCGGTTT<br>ACGAATCTGTTCGTCGTGTTTGGCGTCACATGGGTAAACAGGGTCGTACTGGCGTAAAGACGTTCGTTC<br>TGGTGAACGTCCGAAAATCCGTGGTTACGCGAAAGACGTTGTTGGTGGTAACCTCTATCGAACAGATCGA<br>ATACCTGGAACGTCAGTACAAATTCCTGAAATCTTGGTCTTTTCGGTAAAGTTTCTGGTCAGGTTATC<br>CGTGCGGAAAAGGTTCTCGTTTCGCGATCACCCTGCGTGAACACATCGACCACGCGAAGAAGACCGT<br>CTGAAAAAACTGGCGGACCGTATCATCATGGAAGCGCTGGGTTACGTTTACGCGCTGGACAACGTGGT<br>AAAGGTAAATGGGTTGCGAAATACCCGCCGTGCCAGCTGATCTGGTGGAAGAACTGTCTGAATACCAA<br>TTCAACAACGACCGTCCGCCGTCTGAAAACAACCAGCTGATGCAGTGGTCTCACCGTGGTGTTTTCCAGG<br>AACTGATCAACCAGGCGCAGGTTCACGACCTGCTGGTTGTACCATGTACGCGGCGTTCTCTTCTCGTTT<br>CGACGCGCGTACCGGTGCGCCGGGTATCCGTTGCCGTCGTGTTCCGGCGCGTTGCACCCAGGAACACAA<br>CCCGGAACCGTTCCCGTGGTGCTGAACAAATTCGTTGTTGAACACACCCTGGACGCGTTGCCCGCTGCGT<br>GCGGACGACCTGATCCCGACCGGTGAAGGTGAAATCTTCGTTTCTCCGTTCTCTGCGGAAGAAGGTGAC<br>TTCCACCAGATCCACGCGGACCTGAACGCGGCGCAGAACCTGCAGCAGCGTCTGTGGTCTGACTTCGAC<br>ATCTCTCAGATCCGTCTGCGTTGCGACTGGGGTGAAGTTGACGGTGAACTGGTTCTGATCCCGCGTCTGA<br>CCGGTAAACGTACCGGCGGACTCTTACTCTAACAAAGTTTTCTACACCAACCACCGGTTTACCTACTACGA<br>ACGTGAACGTGGTAAAAACGTCGTAAAGTTTTCGCGCAGGAAAAACTGTCTGAAGAAGAAGCGGAAC<br>TGCTGGTTGAAGCGGACGAAGCGCGTGAAAAATCTGTTGTTCTGATGCGTGACCCGTCTGGTATCATCA<br>ACCGTGGTAACTGGACCCCGTCAGAAAGAATTCTGGTCTATGGTTAACCAGCGTATCGAAGGTTACCTGG<br>TTAAACAGATCCGGTTCTCGTGTTCCGCTGCAGGACTCTGCGTGCGAAAACACCGGTGACATCTAA |

TABLE 5-continued

| SEQ ID NO | Sequence |
|---|---|
| SEQ ID NO: 54 | ATGGCGACCCGTTCTTTCATCCTGAAAATCGAACCGAACGAAGAAGTTAAAAAGGTCTGTGGAAAACC<br>CACGAAGTTCTGAACCACGGTATCGCGTACTACATGAACATCCTGAAACTGATCCGTCAGGAAGCGATC<br>TACGAACACCACGAACAGGACCCGAAAAACCCGAAAAAAGTTTCTAAAGCGGAAATCCAGGCGGAACT<br>GTGGGACTTCGTTCTGAAAATGCAGAAATGCAACTCTTTCACCCACGAAGTTGACAAAGACGTTGTTTTC<br>AACATCCTGCGTGAACTGTACGAAGAACTGGTTCCGTCTTCTGTTGAAAAAAAAGGTGAAGCGAACCAG<br>CTGTCTAACAAATTCCTGTACCCGCTGGTTGACCCGAACTCTCAGTCTGGTAAAGGTACCGCGTCTTCTG<br>GTCGTAAACCGCGTTGGTACAACCTGAAAATCGCGGGTGACCCGTCTTGGGAAGAAGAAAAAAAAAAA<br>TGGGAAGAAGACAAAAAAAAAGACCCGCTGGCGAAAATCCTGGGTAAACTGGCGGAATACGGTCTGAT<br>CCCGCTGTTCATCCCGTTCACCGACTCTAACGAACCGATCGTTAAAGAAATCAAATGGATGGAAAAATC<br>TCGTAACCAGTCTGTTCGTCGTCTGGACAAAGACATGTTCATCCAGGCGCTGGAACGTTTCCTGTCTTGG<br>GAATCTTGGAACCTGAAAGTTAAAGAAGAATACGAAAAAGTTGAAAAAGAACACAAAACCCTGGAAGA<br>ACGTATCAAAGAAGACATCCAGGCGTTCAAATCTCTGGAACAGTACGAAAAAGAACGTCAGGAACAGC<br>TGCTGCGTGACACCCTGAACACCAACGAATACCGTCTGTCTAAACGTGGTCTGCGTGGTTGGCGTGAAA<br>TCATCCAGAAATGGCTGAAAATGGACAGAAAACGAACCGTCTGAAAATACCTGGAAGTTTTCAAAGACT<br>ACCAGCGTAAACACCCGCGTGAAGCGGGTGACTACTCTGTTTACGAATTCCTGTCTAAAAAAGAAAACC<br>ACTTCATCTGGCGTAACCACCCGGAATACCCGTACCTGTACGCGACCTTCTGCGAAATCGACAAAAAAA<br>AAAAAGACGCGAAACAGCAGGCGACCTTCACCCTGGCGGGTTCCGATCAACCACCCGCTGTGGGTTCGTT<br>TCGAAGAACGTTCTGGTTCTAACCTGAACAAATACCGTATCCTGACCGAACAGCTGCACACCGAAAAAC<br>TGAAAAAAAAACTGACCGTTCAGCTGGACCGTCTGATCTACCCGACCGAATCTGGTGGTTGGGAAGAAA<br>AAGGTAAAGTTGACATCGTTCTGCTGCCGTCTCGTCAGTTCTACAACCAGATCTTCCTGGACATCGAAGA<br>AAAAGGTAAACACGCGTTCACCTACAAAGACGAATCTATCAAATTCCCGCTGAAAGGTACCCTGGGTGG<br>TGCGCGTGTTCAGTTCGACCGTGACCACCTGCGTCGTTACCCGCACAAAGTTGAATCTGGTAACGTTGGT<br>CGTATCTACTTCAACATGACCGTTAACATCGAACCGACCGAATCTCCGGTTTCTAAATCTCTGAAAATCC<br>ACCGTGACGACTTCCCGAAATTCGTTAACTTCAAACCGAAAGAACTGACCGAATGGATCAAAGACTCTA<br>AAGGTAAAAAACTGAAATCTGGTATCGAATCTCTGGAAATCGGTCTGCGTGTTATGTCTATCGACCTGG<br>GTCAGCGTCAGGCGGCGGCGGCGTCTATCTTCGAAGTTGTTGACCAGAAACCGGACATCGAAGGTAAAC<br>TGTTCTTCCCGATCAAAGGTACCGAACTGTACGCGGTTCACCGTGCGTCTTTCAACATCAAACTGCCGGG<br>TGAAACCCTGGTTAAATCTCGTGAAGTTCTGCGTAAAGCGCGTGAAGACAACCTGAAACTGATGAACCA<br>GAAACTGAACTTCCTGCGTAACGTTCTGCACTTCCAGCAGTTCGAAGACATCACCGAACGTGAAAAACG<br>TGTTACCAAATGGATCTCTCGTCAGGAAAACTCTGACGTTCCGCTGGTTTACCAGGACGAACTGATCCAG<br>ATCCGTGAACTGATGTACAAACCGTACAAAGACTGGGTTGCGTTCCTGAAACAGCTGCACAAACGTCTG<br>GAAGTTGAAATCGGTAAAGAAGTTAAACACTGGCGTAAATCTCTGTCTGACGGTCGTAAAGGTCTGTAC<br>GGTATCTCTCTGAAAAACATCGACGAAATCGACCGTACCCGTAAATTCCTGCTGCGTTGGTCTCTGCGTC<br>CGACCGAACCGGGTGAAGTTCGTCGTCTGGAACCGGGTCAGCGTTTCGCGATCAGCTGAACCACC<br>TGAACGCGCTGAAAGAAGACCGTCTGAAAAAAATGGCGAACACCATCATCATGCACGCGCTGGGTTACT<br>GCTACGACGTTCGTAAAAAAAAAATGGCAGGCGAAAAACCCGGCGTGCCAGATCATCCTGTTCGAAGACC<br>TGTCTAACTACAACCCGTACGAAGAACGTTCTCGTTTCGAAAACTCTAAACTGATGAAATGGTCTCGTCG<br>TGAAATCCCGCGTCAGGTTGCGCTGCAGGGTGAAATCTACGGTCTGCAGGTTGGTGAAGTTGGTGCGCA<br>GTTCTCTTCTCGTTTCCACGCGAAAACCGGTTCTCCGGGTATCCGTTGCTCTGTTGTTACCAAAGAAAAA<br>CTGCAGGACAACCGTTTCTTCAAAAACCTGCAGCGTGAAGGTCGTCTGACCCTGGACAAAATCGCGGTT<br>CTGAAAGAAGGTGACCTGTACCCGGACAAAGGTGGTGAAAAATTCATCTCTCTGTCTAAAGACCGTAAA<br>CTGGTTACCACCCACGCGGACATCAACGCGGCGCAGAACCTGCAGAACCACGTTTCTGGACCGTACCCAC<br>GGTTTCTACAAAGTTTACTGCAAAGCGTACCAGGTTGACGGTCAGACCGTTTACATCCCGGAATCTAAA<br>GACCAGAAACAGAAATCATCGAAGAATTCGGTGAAGGTTACTTCATCCTGAAAGACGGTGTTTACGAA<br>TGGGGTAACGCGGGTAAACTGAAAATCAAAAAAGGTTCTTCTAAACAGTCTTCTTCTGAACTGGTTGAC<br>TCTGACATCTGAAAGACTCTTTCGACCTGGCGTCTGAACTGAAAGGTGAAAAACTGATGCTGTACCGT<br>GACCCGTCTGGTAACGTTTTCCCGTCTGACAAATGGATGGCGGCGGGTGTTTTCTTCGGTAAACTGGAAC<br>GTATCCTGATCTCTAAACTGACCAACCAGTACTCTATCTCTACCATCGAAGACGACTCTTCTAAACAGTC<br>TATGTAA |
| SEQ ID NO: 55 | ATGCCGACCCGTACCATCAACCTGAAACTGGTTCTGGGTAAAAACCCGGAAAACGCGACCCTGCGTCGT<br>GCGCTGTTCTCTACCCACCGTCTGGTTAACCAGGCGACCAAACGTATCGAAGAATTCCTGCTGCTGTGCC<br>GTGGTGAAGCGTACCGTACCGTTGACAACGAAGGTAAAGAAGCGGAAATCCCGCGTCACGCGGTTCAG<br>GAAGAAGCGCTGGCGTTCGCGAAAGGGCGCAGCGTCACAACGGTTGCATCTCTACCTACGAAGACCAG<br>GAAATCCTGGACGTTCTGCGTCAGCTGTACGAACGTCTGGTTCCGTCTGTTAACGAAAACAACGAAGCG<br>GGTGACGCGCAGGCGGCGAACGCGTGGGTTTCTCCGCTGATGTCTGCGGAATCTGAAGGTGGTCTGTCT<br>GTTTACGCAAAGTTCTGGACCCGCCGCCGGTTTGGATGAAACTGAAAGAAGAAAAAGCGCCGGGTTGG<br>GAAGCGGCGTCTCAGATCTGGATCCAGTCTGACGAAGGTCAGTCTCTGCTGTGAACAAACCGGGTTCTCCG<br>CCGCGTTGGATCCGTAAACTGCGTTCTGGTCAGCCGTGGCAGGACGACTTCGTTTCTGACCAGAAAAA<br>AAACAGGACGAACTGACCAAAGGTAACGCGCCGCTGATCAAACAGCTGAAAGAAATGGGTCTGCTGCC<br>GCTGGTTAACCCGTTCTTCCGTCACCTGCTGGACCCGGAAGGTAAAGGTGTTTCTCCGTGGGACCGTCTG<br>GCGGTTCGTGCGGCGGTTGCGCACTTCATCTCTTGGGAATCTTGGAACCACGTACCCGTGCGGAATACA<br>ACTCTCTGAAACTGCGTCGTGACGAATTCGAAGCGGCTTCTGACGATCAAAGACGACTTCACCCTGC<br>TGCGTCAGTACGAAGCGAAACGTCACCTACCCGTGAAATCTATCGCGCTGGCGGACGACTCTAACCCGT<br>ACCGTATCGGTGTTCGTTCTCTGCGTGCGTGGAACCGTGTTCGTGAAGAATGGATCGACAAAGGTGCGA<br>CCGAAGAACAGCGTGTTACCATCCTGTCTAAACTGCAGACCCAGCTGCGTGGTAAATTCGGTGACCCGG<br>ACCTGTTCAACTGGCTGCGCAGGACCGTCACGTTCACCTGGCGTTCTCCGCGTGACTCTGTTACCCCGCT<br>GGTTCGTATCAACGCGGTTGACAAAGTTCTGCGTCGTCGTAAACCGTACGCGCTGATGACCTTCGCGCAC<br>CCGCGTTTCCACCCGCGTTGGATCCTGTACGAAGCGCGGGTGGTTCTAACCTGCGTCAGTACGCGCTGG<br>ACTGCACCGAAAACGCGCTGCACATCACCCTGCCGCTGCTGTTGACGACGCGCACGGTACCTGGATCG<br>AAAAAACCGGTTCCGCTGGCGCCGTCTGGTCAGATCCAGGACCTGAACCACCCGTCTGTTGGTCGGTCTGG<br>AAAAAAAAAAACCGTCTGTACTACCGTTCTGGTTTCCAGCAGTTCGCGGGGTCTGGCGGGTGGTGCGGAAG<br>TTCGTTCCACCGTCCGTACATGAACACGACGAACGTTCTGAAGAATCTCTGCTGGAACGTCCGGGTGC<br>GGTTTGGTTCAAACTGACCCTGGACGTTGCGACCCAGGCGCCGCCGAACTGGCTGGACGGTAAAGGTCG<br>TGTTCGTACCCCGCCGGAAGTTCACCACTTCAAAACCGCGCTGTCTAACAAATCTAAACACACCCCGTACC<br>CTGCAGCCGGGTCTGCGTGTTCTGTCTGTTGACCTGGGTATGCGTACCTTCGCGTCTTGCTCTGTTTTCGA |

| SEQ ID NO | Sequence |
|---|---|
| | ACTGATCGAAGGTAAACCGGAAACCGGTCGTGCGTTCCCGGTTGCGGACGAACGTTCTATGGACTCTCC<br>GAACAAACTGTGGGCGAAACACGAACGTTCTTTCAAACTGACCCTGCCGGGTGAAACCCCGTCTCGTAA<br>AGAAGAAGAAGAACGTTCTATCGCGCGTGCGGAAATCTACGCGCTGAAACGTGACATCCAGCGTCTGAA<br>ATCTCTGCTGCGTCTGGGTGAAGAAGACAACGACAACCGTCGTGACGCGCTGCTGGAACAGTTCTTCAA<br>AGGTTGGGGTGAAGAAGACGTTGTTCCGGGTCAGGCGTTCCCGCGTTCTCTGTTCCAGGGTCTGGGTGCG<br>GCGCCGTTCCGTTCTACCCCGGAACTGTGGCGTCAGCACTGCCAGACCTACTACGACAAAGCGGAAGCG<br>TGCCTGGCGAAACACATCTCTGACTGGCGTAAACGTACCCGTCCGCGTCCGACCTCTCGTGAAATGTGGT<br>ACAAAACCCGTTCTTACCACGGTGGTAAATCTATCTGGATGCTGGAATACCTGGACGCGGTTCGTAAACT<br>GCTGCTGTCTTGGTCTCTGCGTGGTCGTACCTACGGTGCGATCAACCGTCAGGACACCGCGCGTTTCGGT<br>TCTCTGGCGTCTCGTCTGCTGCACCACATCAACTCTCTGAAAGAAGACCGTATCAAACCGGTGCGGACT<br>CTATCGTTCAGGCGGCGCGTGGTTACATCCCGCTGCCGCACGGTAAAGGTTGGGAACAGCGTTACGAAC<br>CGTGCCAGCTGATCCTGTTCGAAGACCTGGCGCGTTACCGTTTCCGTGTTGACCGTCCGCGTCGTGAAAA<br>CTCTCAGCTGATGCAGTGGAACCACCGTGCGATCGTTGCGGAACACCATGCAGGCGGAACTGTACGG<br>TCAGATCGTTGAAAACACCGCGGCGGGTTTCTCTTCTCGTTTCCACGCGGCGACCGGTGCGCCGGGTGTT<br>CGTTGCCGTTTCCTGCTGGAACGTGACTTCGACAACGACCTGCCGAAACCGTACCTGCTGCGTGAACTGT<br>CTTGGATGCTGGGTAACACCAAAGTTGAATCTGAAGAAGAAAAACTGCGTCTGCTGTCTGAAAAAATCC<br>GTCCGGGTTCTCTGGTTCGTGGGACGGTGGTGAACAGTTCGCGACCCTGCACCCGAAACGTCAGACCC<br>TGTGCGTTATCCACGCGGACATGAACGCGGCGCAGAACCTGCAGCGTCGTTTCTTCGGTCGTTGCGGTGA<br>AGCGTTCCGTCTGGTTTGCCAGCCGCACGGTGACGACGTTCTGCGTCTGGCGTCTACCCCGGGTGCGCGT<br>CTGCTGGGTGCGCTGCAGCAGCTGGAAAACGGTCAGGGTGCGTTCGAACTGGTTCGTGACATGGGTTCT<br>ACCTCTCAGATGAACCGTTTCGTTATGAAATCTCTGGGTAAAAAAAAATCAAACCGCTGCAGGACAAC<br>AACGGTGACGACGAACTGGAAGACGTTCTGTCTGTTCTGCCGGAAGAAGACACACCGGTCGTATCACC<br>GTTTTCCGTGACTCTTCTGGTATCTTCTTCCCGTGCAACGTTTGGATCCCGGCGAAACAGTTCTGGCCGGC<br>GGTTCGTGCGATGATCTGGAAAGTTATGGCGTCTCACTCTCTGGGTTAA |
| SEQ ID NO: 56 | ATGACCAAACTGCGTCACCGTCAGAAAAAACTGACCCCACGACTGGGCGGGTTCTAAAAAACGTGAAGTT<br>CTGGGTTCTAACGGTAAACTGCAGAACCCGCTGCTGATGCCGGTTAAAAAGGTCAGGTTACCGAATTC<br>CGTAAAGCGTTCTCTGCGTACGCGCGTGCGACCAAAGGTGAAATGACCGACGGTCGTAAAAACATGTTC<br>ACCCACTCTTTCGAACCGTTCAAAACCAACCGTCTCTGCACCAGTGCGAACTGGCGGACAAAGCGTAC<br>CAGTCTCTGCACTCTTACCTGCCGGGTTCTCTGGCGCACTTCCTGCTGTCTGCACGCGTGGGTTTCCG<br>TATCTTCTCTAAATCTGGTGAAGCGACCGCGTTCCAGGCGTCTTCTAAAATCGAAGCGTACGAATCTAAA<br>CTGGCGTCTGAACTGGCGTGCGTTGACCTGTCTATCCAGAACCTGACCATCTCTACCCTGTTCAACGCGC<br>TGACCACCTCTGTTCGTGGTAAAGGTGAAGAAACCTCTGCCGGACCCGCTGATCGCGCGTTTCTACACCCT<br>GCTGACCGGTAAACCGCTGTCTCGTGACACCCAGGGTCCGGAACGTGACCTGGCGGAAGTTATCTCTG<br>TAAAATCGCGTCTTCTTTCGGTACCTGGAAAGAAATGACCGCGAACCCGCTGCAGTCTCTGCAGTTCTTC<br>GAAGAAGAACTGCACGCGCTGGACGCGAACGTTTCTCTGTCTCCGGCGTTCGACGTTCTGATCAAAATG<br>AACGACCTGCAGGGTGACCTGAAAAACCGTACCATCGTTTTCGACCCGGACGCGCCGGTTTTCGAATAC<br>AACGCGGAAGACCCGGCGGACATCATCATCAAACTGACCGCCGTTACGCGAAAGAAGCGGTTATCAA<br>AAACCAGAACGTTGGTAACTACGTTAAAAACGCGATCACCACCACCAACGCGAACGGTCTGGGTTGGCT<br>GCTGAACAAAGGTCTGTCTCTGCTGCCGGTTTCTACCGACGACGAACTGCTGGAATTCATCGGTGTTGAA<br>CGTTCTCACCCGTCTTGCCACGCGCTGATCGAACTGATCGCGCAGCTGGAAGCGCCGGAACTGTTCGAA<br>AAAAACGTTTTCTCTGACACCCGTTCTGAAGTTCAGGGTATGATCGACTTCTGCGGTTTCTAACCACATCG<br>CGCGTCTGTCTTCTTCTCGTAACTCTCTGTCTATGGACTCTGAAGAACTGGAACGTCTGATCAAATCTTTC<br>CAGATCCACACCCCGCACTGCTCTCTGTTCATCGGTGCGCAGTCTCTGTCTCAGCAGCTGGAATCTCTGC<br>CGGAAGCGCTGCAGTCTGGTGTTAACTCTGCGGACATCCTGCTGGGTTCTACCCAGTACATGCTGACCAA<br>CTCTCTGGTTGAAGAATCTATCGCGACCTACCAGCGTACCCTGAACCGTATCAACTACCTGTCTGGTGTT<br>GCGGGTCAGATCAACGGTGCGATCAAACGTAAAGCGATCGACGGTGAAAAAATCCACCTGCCGGCGGC<br>GTGGTCTGAACTGATCTCTCTGCCGTTCATCGGTCAGCCGGTTATCGACGTTAATCTGACCTGGCGCAC<br>CTGAAAAACCAGTACCAGACCCTGTCTAACGAATTCGACACCCTGATCTCTGCGCTGCAGAAAAACTTC<br>GACCTGAACTTCAACAAAGCGCTGCTGAACCGTACCCAGCACTTCGAAGCGATGTGCCGTTCTACCAAA<br>AAAAACGCGCTGTCTAAACCGGAAATCGTTTCTTACCGTGACCTGCTGGCGCGTCTGACCTCTTGCCTGT<br>ACCGTGGTTCTCTGGTTCTGCGTCGTGCGGGTATCGAAGTTCTGAAAAACACAAAATCTTCGAATCTAA<br>CTCTGAACTGCGTGAACACGTTCACGAACGTAAACATTCGTTTTCGTTTCTCCGCTGGACCGTAAAGCG<br>AAAAAACTGCTGCGTCTGACCGACTCTCGTCCGGACCTGCTGCACGTTATCGACGAAATCCTGCAGCAC<br>GACAACCTGGAAAACAAAGACCGTGAATCTCTGTGGCTGGTTCGTTCTGGTTACCTGCTGGCGGGTCTGC<br>CGGACCAGCTGTCTTCTTCTTTCATCAACCTGCCGATCATCACCCAGAAAGGTGACCGTCGTCTGATCGA<br>CCTGATCCAGTACGACCAGATCAACCGTGACGCGTTCGTTATGCTGGTTACCTCTGCGTTCAAATCTAAC<br>CTGTCTGGTCTGCAGTACCGTGCGAACAAACAGTCTTTCGTTGTTACCCGTACCCTGTCTCGTACCTGG<br>GTTCTAAACTGGTTTACGTTCCGAAAGACAAAGACTGGCTGGTTCCGTCTCAGATGTTCGAAGGTCGTTT<br>CGCGGACATCCTGCAGTCTGACTACATGGTTTGGAAAGACGCGGGTCGTCTGTGCGTTATCGACACCGC<br>GAAACACCTGTCTAACATCAAAAAATCTGTTTTCTCTTCTGAAGAAGTTCTGGCGTTCCTGCGTGAACTG<br>CCGCACCGTACCTTCATCCAGACCGAAGTTCGTGGTCTGGGTGTTAACGTTGACGGTATCGCGTTCAACA<br>ACGGTGACATCCCGTCTCTGAAAACCTTCTCTAACTGCGTTCAGGTTAAAGTTTCTCGTACCAACATCTC<br>TCTGGTTCAGACCCTGAACCGTTGGTTCGAAGGTGGTAAAGTTTCTCCGCCGTCTATCCAGTTCGAACGT<br>GCGTACTACAAAAAGACGACCAGATCCACGAAGACGCGGCGAAACGTAAAATCCGTTTCCAGATGCC<br>GGCGACCGAACTGGTTCACGCGTCTGACGACGCGGGTTGGACCCCGTCTTACCTGCTGGGTATCGACCC<br>GGGTGAATACGGTATGGGTCTGTCTCTGGTTTCTATCAACAACGGTGAAGTTCTGGACTCTGGTTTCATC<br>CACATCAACTCTCTGATCAACTTCGCGTCTAAAAAATCTAACCACCAGACCAAAGTTGTTCCGCGTCAGC<br>AGTACAAATCTCCGTACGCGAACTACCTGGAACAGTCTAAAGACTCTGCGGCGGGTGACATCGCGCACA<br>TCCTGGACCGTCTGATCTACAAACTGAACGCGCTGCCGGTTTTCGAAGCGCTGTCTGGTAACTCTCAGTC<br>TGCGGCGACCAGGTTTGGACAAAGTTCTGTCTTTCTACACCCTGGGGTGACAACGACGCGAACTC<br>TATCCGTAAACAGCACTGGTTCGGTGCGCTCACTCTGGGACATCAAAGGTATGCTGCGCTCAGCCGCTGAC<br>CGAAAAAAAACCGAAACCGTACATCGCGCTTCCCGGGTTCTCAGGTTTCTTTTACGGTAACTCTCAGCGT<br>TGCTCTTGCTGCGGTCGTAACCCGATCGAACAGCGCGTGAAATGGCGAAAGACACCTCTATCAAAGAA<br>CTGAAAATCCGTAACTCTGAAATCCAGCTGTTCGACGGTACCATCAAACTGTTCAACCCGGACCCGTCTA<br>CCGTTATCGAACGTCGTCGTCACAACCTGGGTCCGTCTCGTATCCCGGTTGCGGACCGTACCTTCAAAAA |

TABLE 5-continued

| SEQ ID NO | Sequence |
|---|---|
| | CATCTCTCCGTCTTCTCTGGAATTCAAAGAACTGATCACCATCGTTTCTCGTTCTATCCGTCACTCTCCGG<br>AATTCATCGCGAAAAAACGTGGTATCGGTTCTGAATACTTCTGCGCGTACTCTGACTGCAACTCTTCTCT<br>GAACTCTGAAGCGAACGCGGCGGCGAACGTTGCGCAGAAATTCCAGAAACAGCTGTTCTTCGAACTGTAA |
| SEQ ID NO: 57 | ATGAAACGTATCCTGAACTCTCTGAAAGTTGCGGCGCTGCGTCTGCTGTTCCGTGGTAAAGGTTCTGAAC<br>TGGTTAAAACCGTTAAATACCCGCTGGTTTCTCCGGTTCAGGGTGCGGTGAAGAACTGCGGAAGCGA<br>TCCGTCACGACAACCTGCACCTGTTCGGTCAGAAAGAAATCGTTGACCTGATGGAAAAAGACGAAGGTA<br>CCCAGGTTTACTCTGTTGTTGACTTCTGGCTGGACACCCTGCGTCTGGGTATGTTCTTCTCTCCGTCTGCG<br>AACGCGCTGAAAATCACCCTGGGTAAATTCAACTCTGACCAGGTTTCTCCGTTCCGTAAAGTTCTGGAAC<br>AGTCTCCGTTCTTCCTGGCGGGTCGTCTGAAAGTTGAACCGGCGGAACGTATCCTGTCTGTTGAAATCCG<br>TAAAATCGGTAAACGTGAAACCGTGTTGAAAACTACGCGGCGGACGTTGAAACCTGCTTCATCGGTCA<br>GCTGTCTTCTGACGAAAAACAGTCTATCCAGAAACTGGCGAACGACATCTGGGACTCTAAAGACCACGA<br>AGAACAGCGTATGCTGAAAGCGGACTTCTTCGCGATCCCGCTGATCAAAGACCCGAAAGCGGTTACCGA<br>AGAAGACCCGAAAACGAAACCGCGGGTAAACAGAAACCGCTGGAACTGTGCGTTTGCCTGGTTCCGG<br>AACTGTACACCCGTGGTTTCGGTTCTATCGCGGACTTCCTGGTTCAGCGTCTGACCCTGCTGCGTGACAA<br>AATGTCTACCGACACCGCGGAAGACTGCCTGGAATACGTTGGTATCGAAGAAGAAAAAGGTAACGGTA<br>TGAACTCTCTGCTGGGTACCTTCCTGAAAAACCTGCAGGGTGACGGTTTCGAACAGATCTTCCAGTTCAT<br>GCTGGGTTCTTACGTTGGTTGGCAGGGTAAAGAAGACGTTCTGCGTGAACGTCTGGACCTGCTGGCGGA<br>AAAAGTTAAACGTCTGCCGAAACCGAATTCGCGGGTAATGGTCTGGTCACCGTATGTTCCTGCACGG<br>TCAGCTGAAATCTTGGTCTTCTAACTTCTTCCGTCTGTTCAACGAAACCCGTGAACTGCTGGAATCTATC<br>AAATCTGACATCCAGCACGCGACCATGCTGATCTTACGTTGAAGAAAAAGGTGGTTACCACCCGCAG<br>CTGCTGTCTCAGTACCGTAAACTGATGGAACAGCTGCCGGCGCTGCGTACCAAAGTTCTGGACCCGGAA<br>ATCGAAATGACCCACATGTCTGAAGCGGTTCGTTCTTACATCATGATCCACAAATCTGTTGCGGGTTTCC<br>TGCCGGACCTGCTGGAATCTCTGGACCGTGACAAGACCGTGAATTCCTGCTGTCTATCTTCCCGCGTAT<br>CCCGAAAATCGACAAAAAAACGCAAAAAAATCGTTGCGTGGGAACTGCCGGGTGAACTGCCGGAAGAAGGTT<br>ACCTGTTCACCGCGAACAACCTGTTCCGTAACTTCCTGGAAAAACCCGAAACACGTTCCGCGTTTCATGGC<br>GGAACGTATCCCGGAAGACTGGACCCGTCTGCGTTCTGCGCCGGTTTGGTTCGACGGTATGGTTAAACA<br>GTGGCAGAAAGTTGTTAACCAGCTGGTTGAATCTCCGGGTGCGCTGTACCAGTTCAACGAATCTTTCCTG<br>CGTCAGCGTCTGCAGGCGATGCTGACCGTTTACAAACGTGAACCTGAGACCGAAAATTCCTGAAACTG<br>CTGGCGGACGTTTGCCGTCCGCTGGTTGACTTCTTCGGTCTGGGTGGTAACGACATCATCTTCAAATCTT<br>GCCAGGACCCGCGTAAACAGTGGCAGACCGTTATCCCGCTGTCTGTTCCGGCGGACGTTTACACCGCGT<br>GCGAAGGTCTGGCGATCCGTCTGCGTGAAACCCTGGGTTTCGAATGGAAAAACCTGAAAGGTCACGAAC<br>GTGAAGACTTCCTGCGTCTGCACCAGCTGCTGGGTAACCTGTCTGTTCTGGATCCGTGACGCGAAACTGGT<br>TGTTAAACTGGAAGACTGGATGAACAACCCGTGCGTTCAGGAATACGTTGAAGCGCGTAAAGCGATCGA<br>CCTGCCGCTGGAAATCTTCGGTTTCGAAGTTCCGATCTTCCTGAACGGTTACCTGTTCTCTGAACTGCGTC<br>AGCTGGAACTGCTGCTGCGTCGTAAATCTGTTATGACCTCTTACTCTGTTAAACCACCGGTTCTCCGAA<br>CCGTCTGTTCCAGCTGGTTTACCTGCCGCTGAAACCGTCTGACCCGGAAAAAAAAACTCTAACAACTTC<br>CAGGAACGTCTGGACACCCCGACCGGTCTGTCTCGTCGTTTCCTGGACCTGACCCTGGACGCGTTCGCGG<br>GTAAACTGCTGACCGACCCGGTTACCCAGGAACTGAAAACCATGGCGGGTTTCTACGACCACCTGTTCG<br>GTTTCAAACTGCCGTGCAAACTGGCGGCGATGTCTAACCACCCGGGTTCTTCTTCTAAAATGGTTGTTCT<br>GGCGAAACCGAAAAAAGGTGTTGCGTCTAACATCGGTTTCGAACCGATCCCGGACCCGGCGCACCCGGT<br>TTTCCGTGTTCGTTCTTCTTGGCCGGAACTGAAATACCTGGAAGGTCTGCTGTACCTGCCGGAAGACACC<br>CCGCTGACCATCGAACTGGCGGAAACCTCTGTTTCTTGCCAGTCTGTTTCTTCTGTTGCGTTCGACCTGAA<br>AAACCTGACCACCATCCTGGGTCGTGTTGGTGAATTCCGTGTTACCGCGGACCAGCCGTTCAAACTGACC<br>CCGATCATCCCGGAAAAGAAGAATCTTTCATCGGTAAAACCTACCTGGGTCTGGACGCGGGTGAACGT<br>TCTGGTTGGTTTCGCGATCGTTACCGTTGACGGTGACGGTTACGAAGTTCAGCGTCTGGAGTTCACG<br>AAGACACCCAGCTGATGGCGCTGCAGCAGGTTGCGTCTAAATCTCTGAAAGAACCGGTTTTCCAGCCGC<br>TGCCGTAAAGGTACCTTCCGTCAGCAGGAACGTATCCGTAAATCTCTGCGTGGTTGCTACTGGAACTTCTA<br>CCACGCGCTGATGATCAAATACCGTGCGAAAGTTGTTCACGAAGAATCTGTTGGTTCTTCTGGTCTGGTT<br>GGTCAGTGGCTGCGTGCGTTCCAGAAAGACCTGAAAAAAGCGGACGTTCTGCCGAAAAAAGGTGTAA<br>AAACGGTGTTGACAAAAAAAAACGTGAATCTTCTGCGCAGGACACCCTGTGGGGTGGTGCGTTCTCTAA<br>AAAAGAAGAACAGCAGATCGCGTTCGAAGTTCAGGCGGCGGGTTCTTCTCAGTTCTGCCTGAAATGCGG<br>TTGGTGGTTCCAGCTGGGTATGCGTGAAGTTAACCGTGTTCAGGAATCTGGTGTTGTTCTGGACTGGAAC<br>CGTTCTATCGTTACCTTCCTGATCGAATCTTCTGGTGAAAAAGTTTACGGTTTCTCTCCGCAGCAGCTGGA<br>AAAAGGTTTCCGTCCGGACATCGAAACCTTCAAAAAAATGGTTCGTGACTTCATGCGTCCGCCGATGTTC<br>GACCGTAAAGGTCGTCCGGCGGCGGCGTACGAACGTTTCGTTCGGGTCGTCGTCACCGTCGTTACCGTT<br>TCGACAAAGTTTTCGAAGAACGTTTCGGTCGTTCTGCGCTGTTCATCTGCCCGCGTGTTGGTTGCGGTAA<br>CTTCGACCACTCTTCTGAACAGTCTGCGGTTGTTCTGGCGCTGATCGGTTACATCGCGGACAAAGAAGGT<br>ATGTCTGGTAAAAAACTGGTTTACGTTCGTCTGGCGGAACTGATGGCGGAATGGAAACTGAAAAAACTG<br>GAACGTTCTCGTGTTGAAGAACAGTCTTCTGCGCAGTAA |
| SEQ ID NO: 58 | ATGGCGGAATCTAAACAGATGCAGTGCCGTAAATGCGGTGCGTCTATGAAATACGAAGTTATCGGTCTG<br>GGTAAAAAATCTTGCCGTTACATGTGCCCGGACTGGGTAACCACCGTCTGCCGTTAAATCCAGAAC<br>AAAAAAAACGTGACAAAAAATACGGTTCTGCGTCTAAACGCAGTCTCAGCGTATCGCGGTTGCGGGT<br>GCGCTGTACCGGACAAAAAAGTTCAGACCATCAAAACCTACAAATACCGGCGGACCTGAACGGTGA<br>AGTTCACGACTCTGGTGTTGCGGAAAAAATCGCGCAGGCGATCCAGGAAGACGAAATCGGTCTGCTGGG<br>TCCGTCTTCTGAATACGCGTGCTGGATCGCGTCTCAGAACGACTTCTGTTGTTGACTTC<br>TGGTTCGACGCGGTTTGCGCGGGTGGTGTTTTCGCGTACTCTGGTGCGCGTCTGCTGTCTACCGTTCTGCA<br>GCTGTCTGGTGAAGAATCTGTTCTGCGTGCGGCGCTGGCGTCTTCCCGTTCGTTGACGACATCAACCTG<br>GCGCAGGCGGAAAATTCCTGGCGGTTTCTCGTCGTACCGGTCAGGACAAACTGGGTAAACGTATCGGT<br>GAATGCTTCGCGGAAGGTCGTCTGGAAGCGTGGTGGTATCAAAGACCGTATGCTGGAATTCGTTCAGGCG<br>ATCGACGTTGCGCAGACCGCGGGTCAGCGTTTCGCGGCGAAACTGAAAATCTTCGGTATCTCTCAGATG<br>CCGGAAGCGAAACAGTGGAACAACGACTCTGGTCTGACCGTTTGCATCCTGCCGGACTACTACGTTCCG<br>GAAGAAAACCGTGCGGACCAGCTGGTTGTTCTGCTGCGTCGTCTGCGTGAAATCGCGTACTGCATGGGT<br>ATCGAAGACGAAGCGGGTTTCGAACACCTGGGTATCGACCCGGGTGCGCTGTCTAACTTCTCTAACGGT<br>AACCCGAAACGTGGTTTCCTGGGTCGTCTGCTGAACAACGACATCATCGCGCTGGCGAACAACATGTCT |

TABLE 5-continued

| SEQ ID NO | Sequence |
|---|---|
| | GCGATGACCCCGTACTGGGAAGGTCGTAAAGGTGAACTGATCGAACGTCTGGCGTGGCTGAAACACCGT<br>GCGGAAGGTCTGTACCTGAAAGAACCGCACTTCGGTAACTCTTGGGCGGACCACCGTTCTCGTATCTTCT<br>CTCGTATCGCGGGTTGGCTGTCTGGTTGCGCGGGTAAACTGAAAATCGCGAAAGACCAGATCTCTGGTG<br>TTCGTACCGACCTGTTCCTGCTGAAACGTCTGCTGGACGCGGTTCCGCAGTCTGCGCCGTCTCCGGACTT<br>CATCGCGTCTATCTCTGCGCTGGACCGTTTCCTGGAAGCGGCGGAATCTTCTCAGGACCCGGCGGAACA<br>GGTTCGTGCGCTATACGCGTTCCACCTGAACGCGCCGGCGGTTCGTTTATCGCGAACAAAGCGGTTCAG<br>CGTTCTGACTCTCAGGAATGGCTGATCAAAGAACTGGACGCGGTTGACCACCTGGAATTCAACAAAGCG<br>TTCCCGTTCTTCTCTGACACCGGTAAAAAAAAAAAAAAGGTGCGAACTCTAACGGTGCGCCGTCTGAA<br>GAAGAATACACCGAAACCGAATCTATCCAGCAGCCGGAAGACGCGGAAGCAGGAAGTTAACGGTCAGGA<br>AGGTAACGGTGCGTCTAAAAACCAGAAAATTCCAGCGTATCCCGCGTTTCTTCGGTGAAGGTTCTCG<br>TTCTGAATACCGTATCCTGACCGAAGCGCCGCAGTACTTCGACATGTTCTGCAACAACATGCGTGCGATC<br>TTCATGCAGCTGGAATCTCAGCCGCGTAAAGCGCCGCGTGACTTCAAATGCTTCCTGCAGAACCGTCTGC<br>AGAAACTGTACAAACAGACCTTCCTGAACGCGCGTTCTAACAACGTCCTGTGCGCTGCTGGAATCTGTTCT<br>GATCTCTTGGGGTGAATTCTACACCTACGGTGCGAACGAAAAAAAATTCCGTCTGCGTCACGAAGCGTC<br>TGAACGTTCTTCTGACCCGGACTACGTTGTTCAGCAGGCGCTGGAAATCGCGCGTCGTCTGTTCCTGTTC<br>GGTTTCGAATGGCGTGACTGCTCTGCGGGTAACGTGTTGACCTGGTTGAAATCCACAAAAAAGCGATC<br>TCTTTCTGCTGGCGATCACCCAGGCGGAAGTTTCTGTTGGTTCTTACAACTGGCTGGGTAACTCTACCG<br>TTTCTCGTTACCTGTCTGTTGCGGGTACCGACACCCTGTACGGTACCCAGCTGGAAGAATTCCTGAACGC<br>GACCGTTCTGTCTCAGATGCGTGGTCTGGCGATCCGTCGTCTTCTCAGGAACTGAAAGACGGTTTCGAC<br>GTTCAGCTGGAATCTTCTTGCCAGGACAACCTGCAGCACCTGCTGGTTTACCGTGCGTCTCGTGACCTGG<br>CGGCGTGCAAACGTGCGACCTGCCCGGCGGAACTGGACCCGGAAATCCTGGTTCTGCCGGTTGGTGCGT<br>TCATCGCGTCTGTTATGAAAATGATCGAACGTGGTGACGAACCGCTGGCGGGTGCGTACCTGCGTCACC<br>GTCCGCACTCTTTCGGTTGGCAGATCCGTGTTCGTGGTGTTGCGGAAGTTGGTATGGACCAGGGTACCGC<br>GCTGGCGTTCCAGAAACCGACCGAATCTGAACCGTTCAAAATCAAACCGTTCTCTGCGCAGTACGGTCC<br>GGTTCTGTGGCTGAACTCTTCTTCTTACTCTCAGTCTCAGTACCTGGCGCGGTTTCCTGTCTCAGCCGAAAA<br>ACTGGTCTATGCGTGTTCTGCCGCAGGCGGGTTCTGTTCGTGTTGAACAGCGTGTTGCGCTGATCTGGAA<br>CCTGCAGGCGGGTAAAATGCGTCTGGAACGTTCTGGTGCGCGTGCGTTCTTCATGCCGGTTCCGTTCTCT<br>TTCCGTCCGTCTGGTTCTGGTGACGAAGCGGTTCTGGCGCCGAACCGTTACCTGGGTCTGTTCCCGCACT<br>CTGGTGGTATCGAATACGCGGTTGTTGACGTTCTGGGGTTTCAAAATCCTGGAACGTGGTAC<br>CATCGCGGTTAACGGTTTCTCTCAGAAACGTGGTGAACGTCAGGAAGAAGCGCACCGTGAAAAACAGCG<br>TCGTGGTATCTCTGACATCGGTCGTAAAAAACCGGTTCAGGCGAAGTTGACGCGGCGAACGAACTGCA<br>CCGTAAATACACCGACGTTGCGACCCGTCTGGGTTGCCGTATCGTTGTTCAGTGGGCGCCGCAGCCGAA<br>ACCGGGTACCGCGCCGACCGCGCAGACCGTTTACGCGCGTTCGTACCGAAGCGCCGCGTTCTGG<br>TAACCAGGAAGACCACGCGCGTATGAAATCTTCTTGGGGGTTACACCTGGGGTACCTACTGGGAAAAACG<br>TAAACCGGAAGACATCCTGGGTATCTCTACCCAGGTTTACTGGACCGGTGGTATCGGTGAATCTTGCCCG<br>GCGGTTGCGGTTGCGCTGCTGGGTCACATCCGTGCGACCTCTACCCAGACCGAATGGGAAAAAGAAGAA<br>GTTGTTTTCGGTCGTCTGAAAAAATTCTTCCCGTCTTAA |
| SEQ ID NO: 59 | ATGGAAAAACGTATCAACAAAATCCGTAAAAAACTGTCTGCGGACAACGCGACCAAACCGGTTTCTCGT<br>TCTGGTCCGATGAAAACCCTGCTGGTTCGTGTTATGACCGACGACCTGAAAAAACGTCTGGAAAAACGT<br>CGTAAAAAACCGGAAGTTATGCCGCAGGTTATCTCTAACAACGCGGCGAACAACCTGCGTATGCTGCTG<br>GACGACTACACCAAAATGAAAGAAGCGATCCTGCAGGTTTACTGGCAGGAATTCAAAGACGACCACGTT<br>GGTCTGATGTGCAAATTCGCGCAGCCGGCGTCTAAAAAAATCGACCAGAACAAACTGAAACCGGAAAT<br>GGACGAAAAAGGTAACCTGACCACCGCGGGTTTCGCGTGCTCTCAGTGCGGTCAGCCGCTGTTCGTTTA<br>CAAACTGGAACAGGTTTCTGAAAAAGGTAAAGCGTACACCAACTACTTCGGTCGTTGCAACGTTGCGGA<br>ACACGAAAAACTGATCCTGCTGGCGCAGCTGAAACCGGAAAAAGACTCTGACGAAGCGGTTACCTACTC<br>TCTGGGTAAATTCGGTCAGCGTGCGCTGGACTTCTACTCTATCCACGTTACCAAAGAATCTACCCACCCG<br>GTTAAACCGCTGGCGCAGATCGCGGGTAACCGTTACGCGTCTGGTCCGGTTGGTAAAGCGCTGTCTGAC<br>GCGTGCATGGGTACCATCGCGTCTTTCCTGTCTAAATACCAGGACATCATCATCGAACACCAGAAAGTTG<br>TTAAAGGTAACAGAAACGTCTGGAATCTCTGCGTGAACTGGCGGGTAAAGAAACCGTGGAATACCCGT<br>CTGTTACCCTGCCGCCGCAGCCGCACACCAAAGAAGGTGTTGACGCGTACAACGAAGTTATCGCGCGTG<br>TTCGTATGTGGGTTAACCTGAACCGTGTGGCAGAAACTGAAACTGTCTCGTGACGACGCGAAACCGCTGC<br>TGCGTCTGAAAGGTTTCCCGTCTTTCCCGGTTGTTAACGTCGTGAAAACGAAGTTGACTGGTGGAACAC<br>CATCAACGAAGTTAAAAAACTGATCGACGCGAAACGTGACGTGGTCGTGTTTTCTGGTCTGGTTACC<br>CGCGGAAAAACGTAACACCATCCTGGAAGGTTACAACTACCTGCCGAACGAAAACGACCACAAAAAAC<br>GTGAAGGTTCTCTGGAAAACCCGAAAAAACCGGCGAAACGTCAGTTCGGTGACCTGCTGCTGTACCTGG<br>AAAAAAAATACGCGGGTGACTGGGGTAAAGTTTTCGACGAAGCGTGGGAACGTATCGACAAAAAAATC<br>GCGGGTCTGACCTCTCACATCGAACGTGAAGAAGCGCGTAACGCGGAAGACGCGCAGTCTAAAGCGGTT<br>CTGACCGACTGGCTGCGTGCGAAAGCGTCTTTCGTTCTGGAACGTCTGAAAGAAATGGACGAAAAAGAA<br>TTCTACGCGTGCGAAATCCAGCTGCAGAAATGGTACGGTGACCTGCGTGGTAACCCGTTCGCGGTTGAA<br>GCGGAAACCGTGTTGTTGACATCTCTGTTTTCTCTATCGGTTCTGACGGTCACTCTATCCAGTACCGTA<br>ACCTGCTGGCGTGAAATACCTGGAAAACGGTAAACGTGAATTCTACCTGCTGATGAACTACGGTAAAA<br>AAGGTCGTATCCGTTTCACCGACGGATCGACATCAAAAATCTGGTAAATGGCAGGGGTCTGCTGTACG<br>GTGGTGGTAAAGCGAAAGTTATCGACCTGACCTTCGACCCGGACGACGAACAGCGTGATCATCCTGCCGC<br>TGGCCGTTCGGTACCCGTCAGGGTCGTGAATTCATCTGGAACGACCTGCTGTCTCTGGAAACCGGTCTGAT<br>CAAACTGGCGAACGGTCGTGTTATCGAAAAACCATCTACAACAAAAAATCGGTCGTGACGAACCGG<br>CGCTGTTCGTTGCGCTGACCTTCGAACGTCGTAAGTTGTTAACATCAACCGGTTAACCT<br>GATCGGTGTTGACCGTGGTGAAAACATCCCGGCGGTTATCGCGCTGACCGACCCGGAAGGTTGCCCGCT<br>GCCGGAATTCAAAGACTCTTCTGGTGGTCCGACCGACATCCTGCGTATCGGTGAAGGTTACAAAGAAAA<br>ACAGCGTGCGATCCAGGCGGCGAAAGAAGTTGAACAGCGTCGTGCGGGTGGTTACTCTCGTAAATTCGC<br>GTCTAAATCTCGTAACTGGCCGGACGACATGTTCTGCGCGTGACCTGTTCTACCACGCGGTT<br>ACCCACGACGCGGTTCTGGTTTTCGAAAACCTGTCTCGTGGTTTCGGTCGTCAGGGTAAACGTACCTTCA<br>TGACCGAACGTCAGTACACCAAAATGGAAGACTGGCTGACCGCGAAACTGGCGTACGAAGGTCTGACCT<br>CTAAAACCTACCTGTCTAAAACCCTGGCGCAGTACACCTCTAAAACCTGCTCTAACTGCGGTTTCCACCAT<br>CACCACCGCGGACTACGACGGTATGCTGGTTCGTCTGAAAAAACCTCTGACGGTTGGGCGACCACCCT<br>GAACAACAAAGAACTGAAAGCGGAAGGTCAGATCACCTACTACAACCGTTACAAACGTCAGACCGTTG |

TABLE 5-continued

| SEQ ID NO | Sequence |
|---|---|
| | AAAAAGAACTGTCTGCGGAACTGGACCGTCTGTCTGAAGAATCTGGTAACAACGACATCTCTAAATGGA<br>CCAAAGGTCGTCGTGACGAAGCGCTGTTCCTGCTGAAAAAACGTTTCTCTCACCGTCCGGTTCAGGAAC<br>AGTTCGTTTGCCTGGACTGCGGTCACGAAGTTCACGCGGACGAACAGGCGGCGCTGAACATCGCGCGTT<br>CTTGGCTGTTCCTGAACTCTAACTCTACCGAATTCAAATCTTACAAATCTGGTAAACAGCCGTTCGTTGG<br>TGCGTGGCAGGCGTTCTACAAACGTCGTCTGAAAGAAGTTTGGAAACCGAACGCG |
| SEQ ID NO: 60 | ATGAAACGTATCAACAAAATCCGTCGTCGTCTGGTTAAAGACTCTAACACCAAAAAAGCGGGTAAAACC<br>GGTCCGATGAAAACCCTGCTGGTTCGTGTTATGACCCCCGGACCTGCGTGAACGTCTGGAAAACCTGCGT<br>AAAAAACCGGAAAACATCCCGCAGCCGATCTCTAACACCTCTCGTCGGAACCTGAACAAACTGCTGACC<br>GACTACACCGAAATGAAAAAAGCGATCCTGCACGTTTACTGGGAAGAATTCCAGAAAGACCCGGTTGGT<br>CTGATGTCTCGTGTTGCGCAGCCGGCGCCGAAAAACATCGACCAGCGTAAACTGATCCCGGTTAAAGAC<br>GGTAACGAACGTCTGACCTCTTCTGGTTTCGCGTGCTCTCAGTGCTGCCAGCCGCTGTACGTTTACAAAC<br>TGGAACAGGTTAACGACAAAGGTAAACCGCACACCAACTACTTCGGTCGTTGCAACGTTTCTGAACACG<br>AACGTCTGATCCTGCTGTCTCCGCACAAACCGGAAGCGAACGACGAACTGGTTACCTACTCTCTGGGTA<br>AATTCGGTCAGCGTGCGCTGGACTTCTACTCTATCCACGTTACCCGTGAATCTAACCACCCGGTTAAACC<br>GCTGGAACAGATCGGTGGTAACTCTTGCGCGTCTGGTCCGGTTGGTAAAGCGCTGTCTGACGCGTGCAT<br>GGGTGCGGTTGCGTCTTTCCTGACCAAATACCAGGACATCATCCTGGAACGCACAGAAAGTTATCAAAA<br>AAACGAAAACGTCTGGCGAACCTGAAAGACATCGCGTCTGCGAACGGTCTGGCGTTCCCGAAAATCAC<br>CCTGCCGCCGCAGCCGCACACCAAAGAAGGTATCGAAGCGTACAACAACGTTGTTGCGCAGATCGTTAT<br>CTGGGTTAACCTGAACCTGTGGCAGAAACTGAAAATCGGTCGTGACGAAGCGAAACCGCTGCAGCGTCT<br>GAAAGGTTTCCCGTCTTTCCCGCTGGTTGAACGTCAGGCGACGAAGTTGACTGGTGGGACATGGTTTGC<br>AACGTTAAAAAACTGATCAACGAAAAAAAAGAAGACGGTAAAGTTTTCTGGCAGAACTGGCGGGTTA<br>CAAACGTCAGGAAGCGCTGCTGCCGTACCTGTCTTCTGAAGAAGACCGTAAAAAAGGTAAAAAATTCGC<br>GCGTTACCAGTTCGGTGACCTGCTGCTGCACCTGGAAAAAAAACACGGTGAAGACTGGGGTAAAGTTTA<br>CGACGAAGCGTGGGAACGTATCGACAAAAAAGTTGAAGGTCGTGTCTAAACACATCAAACTGGAAGAAG<br>AACGTCGTTCTGAAGACGCGCAGTCTAAAGCGGCGTCGACCGACTGGCTGCGTGCGAAAGCGTCTTTCG<br>TTATCGAAGGTCTGAAAGAAGCGGACAAAGACGAATTCTGCCGTTGCGAACTGAAACTGCAGAAATGGT<br>ACGGTGACCTGCGTGGTAAACCGTTCGCGATCGAAGCGGAAAACTCTATCCTGGACATCTCTGGTTTCTC<br>TAAACAGTACAACTGCGCGTTCATCTGGCAGAAAGACGGTGTTAAAAAACTGAACCTGTACCTGATCAT<br>CAACTACTTCAAAGGTGGTAAACTGCGTTTCAAAAAAATCAAACCGGAAGCGTTCGAAGCGAACCGTTT<br>CTACACCGTTATCAACAAAAAATCTGGTGAAATCGTTCCGATGGAAGTTAACTTCAACTTCGACGACCC<br>GAACCTGATCATCCTGCCGCTGGCGTTCGGTAAACGTCAGGGTCGTGAATTCATCTGGAACGACCTGCTG<br>TCTCTGGAAACCGGTTCTCTGAAACTGGCGAACGGTCGTGTTATCGAAAAAACCCTGTACAACCGTCGT<br>ACCCGTCAGGACGAACCGGCGCTGTTCGTTGCGCTGACCTTCGAACGTCGTGAAGTTCTGGACTCTTCTA<br>ACATCAAACCGATGAACCTGATCGGTATCGACCGTGGTGAAAACATCCCGGCGGTTATCGCGCTGACCG<br>ACCCGGAAGGTTGCCCGCTGTCTCGTTTCAAAGACTCTCTGGGTAACCCGACCCACATCCTGCGTATCGG<br>TGAATCTTACAAAGAAAAACAGCGTACCATCCAGGCGGCGAAAGAAGTTGAACAGCGTCGTGCGGGTG<br>GTTACTCTCGTAAATACGCGTCTAAAGCGAAAAACCTGGCGGACGACATGGTTCGTAACACCGCGCGTG<br>ACCTGCTGTACTACGCGGTTACCCAGGACGCGATGCTGATCTTCGAAAACCTGTCTCGTGGTTTCGGTCG<br>TCAGGGTAAACGTACCTTCATGGCGGAACGTCAGTACACCCGTATGGAAGACTGGCTGACCGCGAAACT<br>GGCGTACGAAGGTCTGCCGTCTAAAACCTACCTGTCTAAAACCCTGGCGCAGTACACCTCTAAAACCTG<br>CTCTAACTGCGGTTTCACCATCACCTCTGCGGACTACGACCGTGTTCTGGAAAAACTGAAAAAAACCGC<br>GACCGGTTGGATGACCACCATCAACGGTAAAGAACTGAAAGTTGAAGGTCAGATCACCTACTACAACCG<br>TTACAAACGTCAGAACGTTGTTAAAGACCTGTCTGTTGAACTGGACCGTCTGTCTGAAGAATCTGTTAAC<br>AACGACATCTCTTCTTGGACCAAAGGTCGTTCTGGTGAAGCGCTGTCTCTGCTGAAAAAACGTTTCTCTC<br>ACCGTCCGGTTCAGGAAAAATTCGTTTGCCTGAACTGCGGTTTCGAAACCCACGCGGACGAACAGCGG<br>CGCTGAACATCGCGCGTTCTTGGCTGTTCCTGCGTTCTCAGGAATACAAAAAATACCAGACCAACAAA<br>CCACCGGTAACACCGACAAACGTGCGTTCGTTGAAACCTGGCAGTCTTTCTACCGTAAAAAACTGAAAG<br>AAGTTTGGAAACCG |
| SEQ ID NO: 61 | AAAATTCcatGCAAAATGCTCCGGTTTCATGTCATCAAAATGATGACGTAATTAAGCATTGATAATTGAGATCCCTCTCCCTGACAGGATGATTACATA<br>AATAATAGTGACAAAAATAAATTATTTATTTATCCAGAAATGAATTGGAAATCAGGAGAGCGTTTTCAATCCTACCTCTGGCGCAGTTGATATGTca<br>aaCAGGTtgccgtcactgcgtctttactggctcttctcgctaaccaaaccggtaacccccgcttattaaaagcattctgtaacaaagcgggaccaaagc<br>catgacaaaaacgcgtaacaaagtgtctataatcacggcagaaaagtccacattgattatttgcacggcgtcacactttgctatgccatagcatttt<br>atccataagattagcggatcctacctgacgcttttatcgcaactctctactgtttctccataccccgttttttggctagcaccgccgtatctcgtgtg<br>agataggcggagatacgaactttaagAAGGAGatataccATGGGTAAAATGTATTACCTTGGTTTAGACATTGGCACGAATTCCGTGGGCTACGGGTG<br>ACCGACCCCTCATACCACCTGCTGAAGTTTAAGGGGAACCAATGTGGGTGCGCACGTATTTGCCGCCGGTAATCAGAGCGCGGAACGACGCTCGTTC<br>CGCACATCGCGTCGTCGTTTGGACCGACGCCAACAGCGCGTTAAACTGGTACAGGAGATTTTTGCCCCGGTGATTAGTCCGATCGACCCACGCTTCTTC<br>ATTCGTCTGCATGAATCCGCCCTGTGGCGCGATGACGTCGCGGAGACGGATAAACATATCTTTTTCAATGATCCTACCTATACCGATAAGGAATATTAT<br>AGCGATTACCGACTATCCATCACCTGATCGTTGATCTGATGAAAGCTCTGAGAAACACGATCCGCGGCTGGTTGTACCTTGCAGTGGCGGTTAGTG<br>GCACACCGTGGTCATTTTCTGAACGAGGTGGACAAGGATAATATTGGAGATGTGTTGTCGTTGACGCATTTTATCCGGAGTTTCTCGCGTTCCTGTCG<br>GACAACGGTGTATCACCGTGGGTGTGCGAAAGCAAAGCGCTGCAGGCGACCTTGCTGAGCCGTAACTCAGTGAACGACAAATATAAAGCCCTTAAGTCT<br>CTGATCTTCGGATCCCAGAAACCTGAAGATAACCTGATGCCAATATTTCGGAAGATGGACTCATTCAACTGCTGGCCGGCAAAAGGTAAAGTTAAC<br>AAACTGTTCCCTCAGGAATCGAACGATGCATCCTTCACATTGAATGATAAAGAAGACGCGATAGAAGAAATCCTGGGTACGCTTACACCAGATGAATGT<br>GAATGGATTGCGCATATACGCCGCCTTTTGACTGGGCTATCATGAAACATGCTCTGAAAGATGGCAGGACTATTAGCGAGTCAAAAGTCAAACTGTAT<br>GAGCAGCACCATCACGATCTGACCCAACTTAAATACTTCGTGAAAACCTACCTTGCAAAAGAATACGACGATATTTCCGCAACGTGGATAGCGAAACA<br>ACGAAAACTATGTAGCGTATTCCTATCATGTGAAGAGGTGAAAGTGGCACTCTGCCTAAAAATAAGGCAACGCAAGAAGAGTTTTGTAAGTATGTCCTG<br>GGCAAGGTTAAAAACATTGAATGCTCTGAAGCAGACAAGGTTGACTTTGATGAGATGATTCAGCGCTTACCGACAACTCTTTTATGCCTAAGCAGGTT<br>TCGGGCGAAACCGCGTTATTCCTTATCAGTTATATTATTATGAACTGAAGACAATTCTGAATAAAGCAGCCTCGTACCTGCCTTTCCTGACGCAGTGT<br>GGGAAAAGATGCAATTTCGAACCAGGACAAACTACTGTCGATCATGACGTTCCGTATTCCTTACTTCGTCGGACCCTTGCGAAAAGATAATTCGGAACAT<br>GCATGGCTCGAACGAAAGGCCGTAAGATTTATTCCGGAGACTTTGGATAAATCAGAAGAAGCGTTCATTCGCCGAATGACC<br>AATACCTGTACCTATTATCCCGGCGAAGATGTTTTACCGTTGGATTCGCTGATCTATGAGAATTTATGATTTTAAATGAAATCAATAATATTCGTATT<br>GACGGCTACCCGATTAGTGTTGACGTTAAACAGCAGGTTTTGGCTTGTTCGAAAAAAAACGACGCGTAACCGTGAAAGATATTCAGAACCTGCTGCTG<br>TCTCTCGGAGCTCTGGACAAACACGGAAGCTGACAGGCATCGATACCACTATCCACTCAAACTATAATACGTATCACCATTTTAAATCTCTCATGGAA<br>CGCGGCGTCCTGACCCGGGATGACGTGGAACGCATCGTTGAAAGGATGACCTACAGCGACGATACTAAGCGTGTGCGTCTGTGCTGAATAACAACTAT<br>GGTACTTTAACCGCCGACGATGTGAAACACATTTCGCGTCTGCGCAAACACGATTTTGGCCGTTTATCCAAAATGTTCTTAACAGGTCTGAAGGGTGTC</td> |

| SEQ ID NO | Sequence |
|---|---|
| | CATAAGGAGACCGGTGAACGTGCCTCCATACTGGATTTCATGTGGAACACGAACGATAACCTGATGCAGCTCCTTTCCGAATGCTACACGTTCAGTGAT GAAATCACAAAGCTGCAAGAGGCGTATTATGCAAAAGCCCAGTTGTCTTTAAACGATTTTTTAGACTCGATGTACATCTCTAACGCGGTGAAACGTCCG ATTTACAGAACTCTGGCAGTGGTGAACGATATTCGAAAAGCATGTGGGACGGCCCCTAAACGCATTTTCATCGAAATGGCTCGTGATGGTGAATCAAAA AAAAAGAGAAGTGTTACACGTCGCGAGCAGATCAAAAACCTGTACCGCTCGATTCGTAAAGATTTCCAGCAGGAAGTTGATTTTCTGGAAAAGATCCTG GAAAATAAATCTGATGGTCAACTTCAGTCAGATGCTTTGTATCTTTACTTTGCACAATTAGGGCGCGATATGTACACGGGCGATCCAATAAAGCTGGAG CACATCAAAGATCAGAGTTTCTATAACATAGACCATATTTACCCGCAGTCTATGGTGAAAGACGATTCCCTAGATAACAAAGTGCTGGTGCAAAGCGAA ATTAACGGCGAGAAAAGCTCGCGATACCCTTTGGACGCCGCGATCCGCAATAAAATGAAGCCCCTTTGGGACGCTTACTATAATCATGGCCTGATCTCC TTAAAGAAATACCAGCGTCTAACGCGCTCGACCCCGTTTACCGATGATGAAAAATGGGACTTTATTAATCGCCAGTTAGTGGAAACCCGTCAATCTACC AAAGCGCTGGCCATTTTGTTGAAGCGTAAGTTTCCAGACACCGAAATTGTGTATTCGAAGGCGGGGTTTATCGTCCGACTTCAGACATGAATTCGGCCTT GTAAAAAGTCGCAATATTAATGATTTTGCACCACGCTAAAGACGCATTCTTGGCTATCGTTACCGGCAATGTGTACCATGAAAGATTCAATCGCAGATGG TTTATGGTGAACCAGCCGTACTCAGTTAAAACTAAAACTCTTTTTACCCACAGCATAAAGAATGGCAACTTCGTTGCCTGGAACGGCGAAGAAGATCTC GGTCGTATTGTAAAAATGCTGAAGCAAACAAAAATACCATTCACTTCACGCGCTTCTCCTTCGATCGCAAAGAAGGATTATTTGATATCCAACCTCTG AAAGCCAGCACCGGCTTAGTCCCACGAAAAGCCGGTCTGGATGTCGTTAAATACGGCGATATGACAAATCTACCGCGGCCTATTACCTGCTGGTGAGG TTCACGCTCGAGGACAAGAAAACCAGCACAAGCTGATGATGATTCCTGTAGAAGGCCTGTACAAGGCTCGCATTGATCATGACAAGGAATTTCTTACC GATTATGCGCAAACGACTATAAGCGAAATCCTACAGAAAGATAAACAGAAAGTGATCAATATTATGTTTCCAATGGGTACGAGGCATATAAAACTCAAT TCAATGATTAGTATCGATGGCTTCTATCTTAGTATCGGCGGAAAGTCCTCTAAAGGTAAGTCAGTTCTATGTCACGCAATGGTTCCACTGATCGTCCCT CACAAAATCGAATGTTACATTAAAGCAATGGAAAGCTTCGCCCGGAAGTTTAAAGAAAACAACAAGCTGCGCATCGTAGAAAAATTCGATAAAATCACC GTTGAAGACAACCTGAATCTCTACGAGCTCTTTCTCAAAAACTGCAGCATAATCCCTATAATAAGTTTTTTTCGACACAGTTTGACGTACTGACGAAC GGCCGTTCTACTTTCACAAAACTGTCGCCGGAGGAACAGGTACAGACGCTCTTGAACATTTTAAGTATCTTTAAACATGCCGCAGTTCGGGTTGCGAC CTGAAATCCATCAACGGCAGTGCCCAGGCAGCGCGCATCATGATTAGCGCTGACTTAACTGGACTGTCGAAAAAATATTCAGATATTAGGTTGGTTGAA CAGTCAGCTTCTGGTTTGTTCGTATCCAAAAGTCAGAACTTACTGAGATCTCTAAGAAATCATCCTTAGCGAAAGCTAAGGATTTTTTTTATCTGAA ATTTATTATATCGCGTTGATTATTGATGCTGTTTTTAGTTTTAACGGCAATTAATATATGTGTTATTAATTGAATGAATTTTATCATTCATAATAAGTA TGTGTAGGATCAAGCTCAGGTTAAATATTCACTCAGGAAGTTATTACTCAGGAAGCAAAGAGGATTACAGAATTATCTCATAACAAGTGTTAAGGGATG TTATTTCC |
| SEQ ID NO: 62 | AAAATTCcatGCAAAATGCTCCGGTTTCATGTCATCAAAATGATGACGTAATTAAGCATTGATAATTGAGATCCCTCTCCCTGACAGGATGATTACATA AATAATAGTGACAAAAATAAATTATTTTATTTATCCAGAAAATGAATTGGAAATCAGGAGAGCGTTTTCAATCCTACCTCTGGCGCAGTTGATATGTCa aaCAGGTtgccgtcactgcgtctttttactggctcttctcgctaaccaaaccggtaaccccgcttattaaaagcattctgtaacaaagcgggaccaaagc catgacaaaaacgcgtaacaaaagtgtctataatcacggcagaaaagtccacattgattatttgcacggcgtcacactttgctatgccatagcattttt atccataagattagcggatcctacctgacgcttttttatcgcaactctctactgtttctccataccccgtttttttgggctagcaccgcctatctcgtgtg agataggcggagatacgaactttaagAAGGAGatataccATGTCATCGTCTCACGAAATTCACTAACAAATAACTCTAAACAGCTCACCATTAAGAATGAA CTCATCCCAGTTGGCAAAACACTGGAGAACATCAAAGAGAATGGTCTGATAGATGGCGACGAACAGCTGAATGAGAATTATCAGAAGGCGAAAATTATT GTGGATGATTTTCTGCGGGACTTCATTAATAAAGCACTGAATAATACGCAGATCGGGAACTGGCGCGAACTGGCGGATGCCCTTAATAAAGAGGATGAA GATAACATCGAGAAATTGCAGGATAAAATTCGGGGAATCATTGTATCCAAATTTGAAACGTTTGATCTGTTTAGCAGCTATTCTATTAATGAAAGATGAA AAGATTATTGACGACGACAATGATGTTGAAGAGGAACTGGATCTGGGCAAGAAGACCAGCTCATTTAAATACATATTTAAAAAAAACCTGTTTAAG TTAGTGTTGCCATCCTACCTGAAAACCACAAACCAGGACAAGCTGAAGATTATTAGCTCGTTTGATAATTTTTCAACGTACTTCCGCGGGTTCTTTGAA AACCGGAAAACATTTTTACCAAGAAACCGATCTCCACAAGTATTGCGTATCGCATTGTTCATGATAACTTCCCGAAATTCCTTGATAACATTCGTTGT TTTAATGTGTGGCAGACGGAATGCCCGCAACTAATCGTGAAAGCAGATAACTATCTGAAAAGACAAAAATGTTATAGCGAAAGATAAAAGTTTGGCAAC TATTTTACCGTGGGCGCGTATGACATATTTCCTGTCTCAGAATGGTATAGATTTTTACAACAATATTATAGGTGGACTGCCAGCGTTCGCCGGCCATGAG AAAATCCAAGGTCTCAATGAATTCATCAATCAAGAGTGCCAAAAAGACAGCGAGCTGAAAAGTAAGCTGAAAACCGTCACGCGTTCAAATGGCGGTA CTGTTCAAACAGATACTCAGCGATCGTGAAAAAAGTTTTGTAATTGATGAGTTCGAGTCGGATGCTCAAGTTATTGACGCCGTTAAAAACTTTTACGCC GAACAGTGCAAAGATAACAATGTTATTTTAACTTATTAAATCTTATCAGAAGATATCGCTTTCTTAAGTGATGACGAACTGGACGGCATATTTCATTGAA GGGAAATACCTGTCGAGCGTTAGTCAAAAACTCTATAGCGATTGGTCAAAATTACGTAACGACATTGAGGATTCGGCTAACTCTAAACAAGGCAATAAA GAGCTGGCCAAGAAGATCAAAACCAACAAAGGGGATGTAGAAAAAGCGATCTCGAAATATGAGTTCTCGCTGTCGGAACTGAACTCGATTGTACATGAT AACACCAAGTTTTCTGACCTCCTTAGTTGTACACTGCATAAGGTGGCTTCTGAGAAACTGGTGAAGGTCAATGAAGGCGACTGGCCGAAACATCTCAAG AATAATGAAGAGAAACAAAAAATCAAAGAGCGCTTGATGCTCTGCTGGAGATCTATAATACACTTCTGATTTTTAACTGCAAAAGCTTCAATAAAAAC GGCAACTTCTATGTCGACTATGATCGTTGCATCAATGAACTGAGTTCGCGTCGTGTATTCCGTGTATAATAAAACGTAACTATTGCACTAAAAAACCTAT AACACGGACAAGTTCAAACTCAATTTTAACAGTCCGCAGCTCGGTGAAGGCTTTTCCAAGTCGAAAGAAAATGACTGTCTGACTCTTTTGTTTAAAAAA GACGACAACTATTATGTAGGCATTATCCGCAAAGGTGCAAAAATCAATTTTGATGATACACAAGCAATCGCCGATAACACCGACAATTGCATCTTTAAA ATGAATTATTCCTACTTAAAGACGCAAAAAAATTTATCCCGAAATGTAGCATTCAGCTGAAAGAAGTCAAGGCCCATTTTAAGAAATCTGAAGATGAT TACATTTTGTCTGATAAAGAGAAATTTGCTAGCCCGCTGGTCATTAAAAAGAGCACATTTTGCTGGCAACTGCACATGTGAAAGGGAAAAAAGGCAAT ATCAAGAAATTTCAGAAAGAATATTCGAAAGAAAACCCCACTGAGTATCGCAATTCTTTAAACGAATGGATTGCTTTTTGTAAAGAGTTCTTAAAAACT TATAAAGCGGCTACCATTTTTGATATAACCACATTGAAAAAGGCAGAGAATATGCTGATATTGTAGAATTCTACAAGGATGTCGATAATAACCGTCTGCTAC AAACTGGAGTTCTGCCCGATTAAAAACCTCGTTTATAGAAAACTGATAGATAACCGGCGACCTGTATCTGTTTCGCATCAATAACAAAGACTTCAGCAGT AAATCGACCGGCACCAAGAACCTTCATCGTTATATTTACAAGCTATATTCGATGAACGTAATCTGAACAATCGACAATTATGCTGAATGGGGAGCA GAACTGTTCTATCGTAAAGAAAGTATTGAGCAGAAAAACCGTATCACACACAAAGCCGGTTCAATTCTCGTGAATAAGGTGTGTAAAGACGGTACAAGC CTGGATGATAAGATACGTAATGAAATTTATCAATATGAGAATAAATTTATTGATACCCTGTCTGATGAAGCTAAAAAGGTGTTACCGAATGTCATTAAA AAGGAAGCTACCCATGACATTACAAAAGATAAACGTTTCACTAGTGACAAATTCTTCTTTCACTGCCCCCTGACAATTAATTATAAGGAAGGCGATACC AAGCAGTTCAATAACGAAGTGCTGAGTTTTCTGCGTGGAAATCCTGACATCAACATTATCGGCATTGACCGCGGAGAGCGTAATTTAATCTATGTAACG GTTATAAACCAGAAAGCGAGATTCTGGATTCGGTTTCATTCAATACCGTGACCAACAAGAGTTCAAAAATCGAGCAGAGTCGATTATGAAGAGAAA TTGGCAGTCCGCGAGAAAGAGAGGATTGAAGCAAAACGTTCCTGGGACTCTATCTCAAAAATTGCGACACTAAAGGAAGGTTATCTGAGCGCAATAGTT CACGAGATCTGTCTGTTAATGATTAAACACAACGCGATCGTTGTCTTAGAGAATCTTAATGCAGGCTTTAAGCGTATTCGTGGCGGTTTATCAGAAAAA AGTGTTTATCAAAAATTCGAAAAAATGTTGATTAACAAACTGAACTATTTGTCAGCAAGAAGGAATCCGACTGGAATAAACCGTCTGCTGCTGAAT GGACTGCAGCTTTCGGATCAGTTTGAAAGCTTCGAAAAAATGGGTATTCAGTCTGGTTTTATTTTTACGTGCCGGCCTGCATATACCTCAAAGATTGAT CCGACCACGGGCTTCGCCAATGTTCTGAATCTGTCGAAGGTACGAATGTTGATGCGATCAAAAGCTTTTTTTCTAACTTCAACGAATTAGTTATAGC AAGAAGAAGCCCTTTTCAAATTCTCATTCGATCTGGATTCACTGAGTAAGAAAGGCTTTAGTAGCTTTGTGAAATTTAGTAAGAGTAAATGGAACGTC TACACCCTTTGGAGAACGTATCATAAAGCCAAAGAATAAGCAAGGTTATCGGGAGGACAAAAGAATCAACTTGACCTTCGAGATGAAGAAGTTACTTAAC GAGTATAAGGTTTCTTTGCTGAAAATAACTTGATTCCGAAATCTCACGAGTGCCAACCTGAAGGATACTTTTTGGAAAGAGCTATTCTTTATCTTC AAGACTACGCTGCAGCTCCGTAACAGCGTTAACGGTAAGAAGATGTCGTCATCTCCCGGTCGAAAAATGCGAAGGGTGAATTCTTCGTTTCGGGA ACGCATAACAAGACTCTTCCGCAAGATTGCGATGCGAACGGTGCATACCATATTGCGTTGAAAGGTCTGATGATACTCGAACGTAACAACCTTGTACGT GAGGAGAAAGATACGAAAAGATTATGGCGATTTCAAACGTGGATTGGTTGAGTACGTGCAGAAACGTAGAGGCGTTCTGTAAGAATCATCCTTAGC GAAAGCTAAGGATTTTTTTTATCTGAAATTTATTATATCGCGTTGATTATTGATGCTGTTTTTAGTTTTAACGGCAATTAATATATGTGTTATTAATTG AATGAATTTTATCATTCATAATAAGTATGTGTAGGATCAAGCTCAGGTTAAATATTCACTCAGGAAGTTATTACTCAGGAAGCAAAGAGGATTACAGAA TTATCTCATAACAAGTGTTAAGGGATGTTATTTCC |

TABLE 5-continued

| SEQ ID NO | Sequence |
|---|---|
| SEQ ID NO: 63 | AATCAGGAGAGCGTTTTCAATCCTACCTCTGGCGCAGTTGATATGTCAAACAGGTTGCCGTCACTGCGTC TTTTACTGGCTCTTCTCGCTAACCAAACCGGTAACCCCGCTTATTAAAAGCATTCTGTAACAAAGCGGGA CCAAAGCCATGACAAAAACGCGTAACAAAAGTGTCTATAATCACGGCAGAAAAGTCCACATTGATTATT TGCACGGCGTCACACTTTGCTATGCCATAGCATTTTTATCCATAAGATTAGCGGATCCTACCTGACGCTT TTTATCGCAACTCTCTACTGTTTCTCCATACCCGTTTTTTTGGGCTAGCAGTAATACGACTCACTATAGGG GTCTCATCTCGTGTGAGATAGGCGGAGATACGAACTTTAAGAGGAGGATATACCATGCACCATCATCAT CACCATAACAACTACGACGAATTCACCAAACTGTACCCGATCCAGAAAACCATCCGTTTCGAACTGAAA CCGCAGGGTCGTACCATGGAACACCTGGAAACCTTCAACTTCTTCGAAGAAGACCGTGACCGTGCGGAA AAATACAAAATCCTGAAAGAAGCGATCGACGAATACCACAAAAAATTCATCGACGAACACCTGACCAA CATGTCTCTGGACTGGAACTCTCTGAAACAGATCTCTGAAAAATACTACAAATCTCGTGAAGAAAAGA CAAAAAAGTTTTCCTGTCTGAACAGAAACGTATGCGTCAGGAAATCGTTTCTGAATTCAAAAAGACGA CCGTTTCAAAGACCTGTTCTCTAAAAAACTGTTCTCTGAACTGCTGAAAGAAGAAATCTACAAAAAGG TAACCACCAGGAAATCGACGCGCTGAAATCTTTCGACAAATTCTCTGGTTACTTCATCGGTCTGCACGA AACCGTAAAAACATGTACTCTGACGGTGACGAAATCACCGCGATCTCTAACCGTATCGTTAACGAAAC TTCCCGAAATTCCTGGACAACCTGCAGAAATACCAGGAAGCGCGTAAAAAATACCCGGAATGGATCATC AAAGCGGAATCTGCGCTGGTTGCGCACAACATCAAATGACGAAGTTTTCTCTCTGGAATACTTCAAC AAAGTTCTGAACCAGGAAGGTATCCAGCGTTACAACCTGGCGCTGGGTGGTTACGTTACCAAATCTGGT GAAAAAATGATGGGTCTGAACGACGCGCTGAACCTGGCGCACCAGTCTGAAAAATCTTCTAAAGGTCGT ATCCACATGACCCCGCTGTTCAAACAGATCCTGTCTGAAAAAGAATCTTTCTCTTACATCCCGGACGTTT TCACCGAAGACTCTCAGCTGCTGCCGTCTATCGGTGGTTTCTTCGCGCAGATCGAAACGACAAAGACG GTAACATCTTCGACCGTGCGCTGGAACTGATCTCTTCTTACGCGGAATACGACACCGAACGTATCTACAT CCGTCAGGCGGACATCAACCGTGTTTCTAACGTTATCTTCGGTGAATGGGGTACCCTGGGTGGTCTGATG CGTGAATACAAAGCGGACTCTATCAACGACATCAACCTGGAACGTACCTGCAAAAAAGTTGACAAATGG CTGGACTCTAAAGAATTCGCGCTGTCTGACGTTCTGGAACGCGATCAAACGTACCGGTAACAACGACGCG TTCAACGAATACATCTCTAAAATGCGTACCGCGCGTGAAAAAATCGACGCGGCGCGTAAAGAAATGAA ATTCATCTCTGAAAAAATCTCTGGTGACGAAGAATCTATCCACATCATCAAACCCTGCTGGACTCTGTT CAGCAGTTCCTGCACTTCTTCAACCTGTTCAAAGCGCGTCAGGACATCCCGCTGGACGGTGCGTTCTACG CGGAATTCGACGAAGTTCACTCTAAACTGTTCGCGATCGTTCCGCTGTACAACAAAGTTCGTAACTACCT GACCAAAAACAACCTGAACACCAAAAAATCAAACTGAACTTCAAAAACCCGACCCTGGCGAACGGTT GGGACCAGAACAAAGTTTACGACTACGCGTCTCTGATCTTCCTGCGTGACGGTAACTACTACCTGGGTAT CATCAACCCGAAACGTAAAAAAAACATCAAATTCGAACAGGGTTCTGGTAACGGTCCGTTCTACCGTAA AATGGTTTACAAACAGATCCCGGGTCCGAACAAAAACCTGCCGCGTGTTTTCCTGACCTCTACCAAAGG TAAAAAAGAATACAAACCGTCTAAAGAAATCATCGAAGGTTACGAACGTGGACAAACACATCCGTGGTG ACAAATTCGACCTGGACTTCTGCCACAAACTGATCGACTTCTTCAAAGAATCTATCGAAAAACACAAAG ACTGGTCTAAATTCAACTTCTACTTCTCTCCGACCGAATCTTACGGTGACATCTCTGAATTCTACCTGGAC GTTGAAAAACAGGGTTACCGTATGCACTTCGAAAACATCTCTGCGGAAACCATCGACGAATACGTTGAA AAAGGTGACCTGTTCCTGTTCCAGATCTACAACAAAGACTTCGTTAAAGCGGCCGACCGGTAAAAAAGAC ATGCACACCATCTACTGGAACGCGGCGTTCTCTCCGGAAAACCTGCAGGACGTTGTTGTTAAACTGAAC GGTGAAGCGGAACTGTTCTACCGTGACAAATCTGACATCAAAGAAATCGTTCACCGTGAAGGTGAAATC CTGGTTAACCGTACCTACAACGGTCGTACCCCGGTTCCGGACAAAATCCACAAAAAACTGACCGACTAC CACAACGGTCGTACCAAAGACCTGGGTGAAGCGAAAGAATACCTGGACAAAGTTCGTTACTTCAAAGCG CACTACGACATCACCAAAGACCGTCGTTACCTGAACGACAAAATCTACTTCCACGTTCCGCTGACCCTGA ACTTCAAAGCGAACGGTAAAAAAAACCTGAACAAAATGGTTATCGAAAATTCCTGTCTGACGAAAAA GCGCACATCATCGGTATCGACCGTGGTGAACGTAACCTGCTGTACTACTCTATCATCGACCGTTCTGGTA AATCATCGACCAGTCTCTGAACGTTATCGACGGTTTCGACTACCGTGAAAACTGACCAGCAGCGTG AAATCGAAATGAAAGACGCGCGTCAGTCTTGGAACGCGATCGGTAAAATCAAAGACCTGAAAGAAGGT TACCTGTCTAAAGCGGTTCACGAAATCACCAAAATGGCGATCCAGTACAACGCGATCGTTGTTATGGAA GAACTGAACTACGTTTCAAACGTGGTCGTTTCAAAGTTGAAAAACAGATCTACCAGAAATTCGAAAAC ATGCTGATCGACAAAATGAACTACCTGGTTTTCAAAGACGCGCCGGACGAATCTCCGGGTGGTGTTCTG AACGCGTACCAGCTGACCAACCCGCTGGAATCTTTCGCGAAATCGGGTAAACAGACCGGTATCCTGTTC TACGTTCCGGCGGCGTACACCTCTAAAATCGACCCCGACCACCGTTTCGTTAACCTGTTCAACACCTCTT CTAAAACCAACGCGCAGGAACGTAAAGAATTCCTGCAGAAATTCGAATCTATCTCTTACTCTGCGAAAG ACGGTGGTATCTTCGCGTTCGCGTTCGACTACCGTAAATTCGGTACCTCTAAAACCGACCACAAAAACGT TTGGACCGCGTACACCAACGGTGAACGTATGCGTTACATCAAAGAAAAAAAACGTAACGAACTGTTCGA CCCGTCTAAAGAAATCAAAGAAGCGCTGACCTCTTCTGGTATCAAATACGACGGTGGTCAGAACATCCT GCCGGACATCCTGCGTTCTAACAACAACGGTCTGATCTACACCATGTACTCTTCTTCATCGCGGCGATC CAGATGCGTGTTTACGACGGTAAAGAAGACTACATCATCTCCGATCAAAAACTCTAAAGGTGAATTC TTCCGTACCGACCCCGAAACGTCGTGAACTGCCGATCGACGCGGACGCCAACGGTGCGTACAACATCGCG CTGCGTGGTGAACTGACCATGCGTGCGATCGCGGAAAAATTCGACCCGGACTCTGAAAAAATGGCGAAA CTGGAACTGAAACACAAAGACTGGTTCGAATTCATGCAGACCCGTGGTGACTAAGAAATCATCCTTAGC GAAAGCTAAGGATTTTTTTTATCTGAAATGTAGGGAGACCCTCAGGTTAAATATTCACTCAGGAAGTTAT TACTCAGGAAGCAAAGAGGATTACA |
| SEQ ID NO: 64 | AAAATTCcatGCAAAATGCTCCGGTTTCATGTCATCAAAATGATGACGTAATTAAGCATTGATAATTGAGATCCCTCTCCCTGACAGGATGATTACATA AATAATAGTGACAAAAATAAATTATTTATTTATCCAGAAATGAATTGGAAAATCAGGAGAGCGTTTTCAATCCTACCTCTGGCGCAGTTGATATGTca aaCAGGTtgccgtcactgcgtcttttactggctcttctcgctaaccaaaccggtaaccccgcttattaaaagcattctgtaacaaagcgggaccaaagc catgacaaaaacgcgtaacaaaagtgtctataatcacggcagaaaagtccacattgattatttgcacggcgtcacactttgctatgccatagcatttt atccataagattagcggatcctacctgacgcttttatcgcaactctctactgtttctccatacccgtttttttgggctagcaccgcctatctcgtgtg agataggcggagatacgaactttaagAAGGAgatataccATGACTAAAACATTTGATTCAGAGTTTTTTAATTTGTACTCGCTGCAAAAAACGGTACGC TTTGAGTTAAAACCCGTGGGAAACCGCGTCATTTGTGGAAGACTTTAAAAACGAGGGCTTGAAACGTGTTGTGAGCGAAGATGAAAGGCGAGCCGTC GATTACCAGAAAGTTAAGGAAATAATTGACGATTACCATCGGGATTTCATTGAAGAAAGTTTAAATTATTTTCCGGAACAGGTGAGTAAAGATGCTCTT GAGCAGGCGTTTCATCTTTATCAGAAACTGAAGGCAGCAAAAGTTGAGGAAGGGAAAAGCGCTGAAAGAATGGGAAGCGCTGCAGAAAAGCTACGT GAAAAAGTGGTGAAATGCTTCTCGGACTCGAATAAAGCCCGCTTCTCAAGGATTGATAAAAAGGAACTGATTAAGGAAGACCTGATAAATTGGTTGGTC GCCCAGAATCGCGAGGATGATATCCCTACGGTCGAAACGTTTAACAACTTCACCACATATTTTACCGGCTTCCATGAGAATCGTAAAAATATTTACTCC AAAGATGATCACGCCACCGCTATTAGCTTTCGCCTTATTCATGAAAATCTTCCAAAGTTTTTTGACAACGTGATTAGCTTCAATAAGTTGAAAGAGGGT |

TABLE 5-continued

| SEQ ID NO | Sequence |
|---|---|
| | TTCCCTGAATTAAAATTTGATAAAGTGAAAGAGGATTTAGAAGTAGATTATGATCTGAAGCATGCGTTTGAAATAGAATATTTCGTTAACTTCGTGACC<br>CAAGCGGGCATAGATCAGTATAATTATCTGTTAGGAGGGAAAACCCTGGAGGACGGGACGAAAAAACAAGGGATGAATGAGCAAATTAATCTGTTCAAA<br>CAACAGCAAACGCGAGATAAAGCGCGTCAGATTCCCAAACTGATCCCCCTGTTCAAACAGATTCTTAGCGAAAGGACTGAAAGCCAGTCCTTTATTCCT<br>AAACAATTTGAAAGTGATCAGGAGTTGTTCGATTCACTGCAGAAGTTACATAATAACTGCCAGGATAAATTCACCGTGCTGCAACAAGCCATTCTCGGT<br>CTGGCAGAGGCGGATCTTAAGAAGGTCTTCATCAAAACCTCTGATTTAAATGCCTTATCTAACACCATTTTCGGGAATTACAGCGTCTTTTCCGATGCA<br>CTGAACCTGTATAAAGAAAGCCTGAAAACGAAAAAAGCGCAGGAGGCTTTTGAGAACTACCGGCCCATTCTATTCACGACCTCATTCAATACTTGGAA<br>CAGTTCAATTCCAGCCTGGACGCGGAAAAACAACAGAGCACCGACACCGTCCTGAACTACTTCATCAAGACCGATGAATTATATTCTCGCTTCATTAAA<br>TCCACTAGCGAGGCTTTCACTCAGGTGCAGCCTTTGTTCGAACTGGAAGCCCTGTCATCTAAGCGCCGCCCACCGGAATCGGAAGATGAAGGGGCAAAA<br>GGGCAGGAAGGCTTCGAGCAGATCAAGCGTATTAAAGCTTACCTGGATACGCTTATGGAAGCGGTACACTTTGCAAAGCCGTTGTATCTTGTTAAGGGT<br>CGTAAAATGATCGAAGGGCTCGATAAAGACCAGTCCTTTTATGAAGCGTTTGAAATGGCGTACCAAGAACTTGAATCGTTAATCATTCCTATCTATAAC<br>AAAGCGCGGAGCTATCTGTCGCGGAAACCTTTCAAGGCCGATAAATTCAAGATTAATTTTGACAACAACACGCTACTGAGCGGATGGGATGCGAACAAG<br>GAAACTGCTAACGCGTCCATTCTGTTTAAGAAAGACGGGTTATATTACCTTGGAATTATGCCGAAAGGTAAGACCTTTCTCTTTGACTACTTTGTATCG<br>AGCGAGGATTCAGAGAAACTGAAACAGCGTCGCCAGAACCGCCTATATACAGACCAGGGGAACCCGGAGGTGGTGAAAGTTACTTCGAAAAAATTCGTTATAAA<br>CTGTTACCAGGGGCTTCAAAGATGTTACCGAAAGTCTTTTTTAGCAACAAAAATATTGGCTTTTACAACCCGTCGGATGACATTTTACGCATTCGCAAC<br>ACAGCCTCTCACACCAAAACGGGACCCCTCAGAAAGGCCACTCAAAAGTTGAGTTTAACCTGAATGATTGTCATAAGATGATTGATTTCTTCAAATCA<br>TCAATTCAGAAACACCCGAATGGGGGTCTTTTGGCTTTACGTTTTCTGATACCAGTGATTTTGAAGACATGAGTGCCTTCTACCGGGAAGTAGAAAAC<br>CAGGGTTACGTAATTAGCTTTGACAAAATCAAAGAGACCTATATACAGACCAGGGTAATCTCTACTTATTCCAGATTTATAACAAGGAT<br>TTCTCGCCCTACAGCAAAGGCAAACCAAACCTGCATACTCTGTACTGGAAAGCCCTGTTTGAAGAAGCGAACCTGAATAACGTAGTGGCGAAGTTGAAC<br>GGTGAAGCGGAAATCTTCTTCCGTCGTCACTCCATTAAGGCCTCTGATAAAGTTGTCCATCCGGCAAATCAGGCCATTGATAATAAGAATCCACACACG<br>GAAAAAACGCAGTCAACCTTTGAATATGACCTCGTTAAAGACAAACGCTACACGCAAGATAAGTTCTTTTTCCACGTCCCAATCAGCCTCAACTTTAAA<br>GCACAGGGGTTTCAAAGTTTAATGATAAAGTCAATTGGGTTCCTCAAGGGCAACCCGGATGTCAACATTATAGGTATAGACAGGGGCGAACGCCATCTG<br>CTTTACTTTACCGTAGTGAATCAGAAAGGTGAAATACTGGTTCAGGAATCATTAAATACCTTGATGTCGGACAAAGGGCACGTTAATGATTACCAGCAG<br>AAACTGGATAAAAAGAACAGGAACGTGATGCTGCGCTAAATCGTGGACCACGGTTGAGAACATTAAAGAGCTGAAAGAGGGGTATCTAAGCCATGTG<br>GTACACAAACTGGCGCACCTCATCATTAAATATAACGCAATAGTCTGCCTAGAAGACTTGAATTTTGGCTTTAAACGCGGCCGCTTCAAAGTGGAAAAA<br>CAAGTTTATCAAAAATTTGAAAAGGCGCTTTATAGATAAACTGAATTATCTGGTTTTTAAAGAAAAAGGAACTTGGTGAGGTAGGGCACTACTTGACAGCT<br>TATCAACTGACGGCCCCGTTCGAATCATTCAAAAAACTGGGCAAACAGTCTGGCATTCTGTTTTACGTGCCGGCAGATTATACTTCAAAAATCGATCCA<br>ACAACTGGCTTTGTGAACTTCCTGGACCTGAGATATCAGTCTGTAGAAAAAGCTAAACAACTTCTTAGCGATTTTAATGCCATTCGTTTTAACAGCGTT<br>CAGAATTACTTTGAATTCGAAATTGACTATAAAAAACTTACTCCGAAACGTAAAGTCGGAACCCAAAGTAAATGGGTAATTTGTACGTATGGCGATGTC<br>AGGTATCAGAACCGTCGGAATCAAAAAGGTCATTGGGAGACCGAAGAAGTGACCGAAAAGCTGAAGGCTCTGTTCGCCAGCGATTCAAAAACT<br>ACAACTGTGATCGATTACGCAAATGATGATAACCTGATAGATGTGATTTTAGAGCAGGATAAAGCCAGCTTTTTTAAAGAACTGTTGTGGCTCCTGAAA<br>CTTACGATGACCTTACGACATTCCAAGATCAAATCGGAAGATGATTTTATTCTGTCACCGGTCAAGAATGAGCAGGGTGAATTCTATGATAGTAGGAAA<br>GCCGGCGAAGTGTGGCCGAAAGACGCCGACGCCAATGGCGCCTATCATATCGCGCTCAAAGGGCTTTGGAATTTGCAGCAGATTAACCAGTGGGAAAAA<br>GGTAAAACCCTGAATCTGGCTATCAAAAACCAGGATTGGTTTAGCTTTATCCAAGAGAAACCGTATCAGGAATGAGAAATCATCCTTAGCGAAAGCTAA<br>GGATTTTTTTTATCTGAAATTTATTATATCGCGTTGATTATTGATGCTGTTTTTAGTTTTAACGGCAATTAATATATGTGTTATTAATTGAATGAATTT<br>TATCATTCATAATAAGTATGTGTAGGATCAAGCTCAGGTTAAATATTCACTCAGGAAGTTATTACTCAGGAAGCAAAGAGGATTACAGAATTATCTCAT<br>AACAAGTGTTAAGGGATGTTATTTCC |
| SEQ ID NO: 65 | AATCAGGAGAGCGTTTTCAATCCTACCTCTGGCGCAGTTGATATGTCAAACAGGTTGCCGTCACTGCGTC<br>TTTTACTGGCTCTTCTCGCTAACCAAACCGGTAACCCCGCTTATTAAAAGCATTCTGTAACAAAGCGGGA<br>CCAAAGCCATGACAAAAACGCGTAACAAAAGTGTCTATAATCACGGCAGAAAAGTCCACATTGATTATT<br>TGCACGGCGTCACACTTTGCTATGCCATAGCATTTTTATCCATAAGATTAGCGGATCCTACCTGACGCTT<br>TTTATCGCAACTCTCTACTGTTTCATCAACCCGTTTTTTTGGGCTAGCAGTAATGACTCACTATAGGG<br>GTCTCATCTCGTGTGAGATAGGCGGAGATACGAACTTTAAGAGGAGGATATACCATGCACCATCATCAT<br>CACCATCATACAGGCGGTCTTCTTAGTATGGACGCGAAAGAGTTCACAGGTCAGTATCCGTTGTCGAAA<br>ACATTACGATTCGAACTTCGGCCCATCGGCCGCACGTGGGATAACCTGGAGGCCCTCAGGCTACTTAGCG<br>GAAGACCGCCATCGTGCCGAATGTTATCCTCGTGCGAAAGAGTTATTGGATGACAACCATCGTGCCTTCC<br>TGAATCGTGTGTTGCCACAAATCGATATGGATTGGCACCCGATTGCGGAGGCCTTTTGTAAGGTACATAA<br>AAACCCTGGTAATAAAGAACTTGCCCAGGATTACAACCTTCAGTTGTCAAAGCGCCGTAAGGAGATCAG<br>CGCATATCTTCAGGATGCAGATGGCTATAAAGGCCTGTTCGCGAAGCCCGCCTTAGACGAAGCTATGAA<br>AATTGCGAAAGAAAACGGGAACGAAAGTGATATTGAGGTTCTCGAAGCGTTTAACGGTTTTAGCGTATA<br>CTTCACCGGTTATCATGAGTCACGCGAGAACATTTATAGCGATGAGGATATGGTGAGCGTAGCCTACCG<br>AATTACTGAGGATAATTTCCCGCGCTTTGTCTCAAACGCTTTGATCTTTGATAAATTAAACGAAAGCCAT<br>CCGGATATTATCTCTGAAGTATCGGGCAATCTTGGAGTTGATGACATTGGTAAGTACTTTGACGTGTCGA<br>ACTATAACAATTTTCTTTCCCAGGCCGGTATAGATGACTACAATCGATTATTGGCGGCCATACAACCGA<br>AGACGGACTGATACAAGCGTTTAATGTCGTATTGAACTTACGTCACCAAAAAGACCCTGGCTTTGAAAA<br>AATTCAGTTCAAACAGCTCTACAAACAAATCCTGAGCGTGCGTACCAGCAAAAGCTACATCCCGAAACA<br>GTTTGACAACTCTAAGGAGATGGTTGACTGCATTTGCGATTATGTCAGCAAAATAGAGAAATCCGAAAC<br>AGTAGAACGGGCCCTGAAACTAGTCCGTAATATCAGTTCTTTCGACTTGCGCGGGATCTTTGTCAATAAA<br>AAGAACTTGCGCATACTGAGCAACAACATGATAGGAGATTGGGACGCGATCGAAACCGCATTGATGCAT<br>AGTTCTTCATCAGAAAACGATAAGAAAAGCGTATATGATAGCGCGGAGGCTTTTACGTTGGATGACATC<br>TTTTCAAGCGTGAAAAATTTTCTGATGCCTCTGCCGAAGATATTGGCAACAGGGCGGAAGACATCTGT<br>AGAGTGATAAGTGAGACGGCCCCTTTTATCAACGATCTGCGAGCGGTGGACCTGGATAGCCTGAACGAC<br>GATGGTTATGAAGCGGCCGTCTCAAAAATTCGGGAGTCGCTGCTGGACCTTATATGGATCTTTTCCATGAAC<br>TGGAAATTTTCTCGGTTGGCGATGAGTTCCCAAAATGCGCAGCATTTTACAGCGAACTGGAGGAAGTCA<br>GCGAACAGCTGATCGAAATTATTCCGTTATTCAACAAGGCGCGTTCGTTCTGCACCCGGAAACGCTATA<br>GCACCGATAAGATTAAAGTGAACTTAAAATTCCCGACCTTGGCGGACGGGTGGGACCTGAACAAAGAG<br>AGAGACAACAAAGCCGGATTCTGCGGAAAGACGGTAAGTATTATCTGGCAATTCTGGATATGAAGAA<br>AGATCTGTCAAGCATTAGGACCAGCGACGAAGATGAATCCAGCTTCGAAAAGATGGAGTATAAACTGTT<br>ACCGAGTCCAGTAAAAATGCTGCCAAAGATATTCGTAAAATCGAAAGCCGCTAAGGAAAAATATGGCCT<br>GACAGATCGTATGCTTGAATGCTACGATAAAGGTATGCATAAGTCGGGTAGTGCGTTTGATCTTGGCTTT<br>TGCCATGAACTCATTGATTATTACAAGCGTTGTATCGCGGATTACCCAAGCTGGGATGTGTTCGATTTCA<br>AGTTTCGCGAAACTTCCGATTATGGGTCCATGAAAGAGTTCAATGAAGATGTGGCCGGAGCCGGTTACT<br>ATATGAGTCTGAGAAAATTCCGTGCAGCGAAGTGTACCGTCTGTTAGACGAGAAATCGATTTATCTATT<br>TCAAATTTATAACAAAGATTACTCTGAAAATGCACATGGTAATAAGAACATGCATACCATGTACTGGGA<br>GGGTCTCTTTTCCCCGCAAAACCTGGAGTCGCCCGTTTTCAAGTTGTCGGGTGGGGCAGAACTTTTCTTT<br>CGAAAATCCTCAATCCCTAACGATGCCAAAACAGTACACCCGAAAGGCTCAGTGCTGGTTCCACGTAAT |

TABLE 5-continued

| SEQ ID NO | Sequence |
|---|---|
| | GATGTTAACGGTCGGCGTATTCCAGATTCAATCTACCGCGAACTGACACGCTATTTTAACCGTGGCGATT<br>GCCGAATCAGTGACGAAGCCAAAAGTTATCTTGACAAGGTTAAGACTAAAAAAGCGGACCATGACATT<br>GTGAAAGATCGCCGCTTTACCGTGGATAAAATGATGTTCCACGTCCCGATTGCGATGAACTTTAAGGCG<br>ATCAGTAAACCGAACTTAAACAAAAAAGTCATTGATGGCATCATTGATGATCAGGATCTGAAAATCATT<br>GGTATTGATCGTGGCGAGCGGAACTTAATTTACGTCACGATGGTTGACAGAAAAGGGAATATCTTATAT<br>CAGGATTCTCTTAACATCCTCAATGGCTACGACTATCGTAAAGCTCTGGATGTGCGCGAATATGACAACA<br>AGGAAGCGCGTCGTAACTGGACTAAAGTGGAGGGCATTCGCAAAATGAAGGAAGGCTATCTGTCATTA<br>GCGGTCTCGAAATTAGCGGATATGATTATCGAAAATAACGCCATCATCGTTATGGAGGACCTGAACCAC<br>GGATTCAAAGCGGGCCGCTCAAAGATTGAAAAACAAGTTTATCAGAAATTTGAGAGTATGCTGATTAAC<br>AAACTGGGCTATATGGTGTTAAAAGACAAGTCAATTGACCAATCAGGTGGCGCGCTGCATGGATACCAG<br>CTGGCGAACCATGTTACCACCTTAGCATCAGTTGGAAAGCAGTGTGGGGTTATCTTTTATATACCGGCAG<br>CGTTCACTAGTAAAATAGATCCGACCACTGGTTTCGCCGATCTCTTTGCCCTGAGTAACGTTAAAAACGT<br>AGCGAGCATGCGTGAATTCTTTTCCAAAATGAAATCTGTCATTTATGATAAAGCTGAAGGCAAATTCGC<br>ATTCACCTTTGATTACTTGGATTACAACGTGAAGAGCGAATGTGGTCGTACGCTGTGGACCGTTTACACC<br>GTTGGTGAGCGCTTCACCTATTCCCGTGTGAACCGCGAATATGTACGTAAAGTCCCCACCGATATTATCT<br>ATGATGCCCTCCAGAAAGCAGGCATTAGCGTCGAAGGAGACTTAAGGGACAGAATTGCCGAAAGCGAT<br>GGCGATACGCTGAAGTCTATTTTTTACGCATTCAAATACGCGCTAGATATGCGCGTTGAGAATCGCGAG<br>GAAGACTACATTCAATCACCTGTGAAAAATGCCTCTGGGGAATTTTTTTGTTCAAAAAATGCTGGTAAAA<br>GCCTCCCACAAGATAGCGATGCAAACGGTGCATATAACATTGCCCTGAAAGGTATTCTTCAATTACGCA<br>TGCTGTCTGAGCAGTACGACCCCAACGCGGAATCTATTAGACTTCCGCTGATAACCAATAAAGCCTGGC<br>TGACATTCATCGAGTCTGGCATGAAGACCTGGAAAAATTAGGAAATCATCCTTAGCGAAAGCTAAGGAT<br>TTTTTTTATCTGAAATGTAGGGAGACCCTCAGGTTAAATATTCACTCAGGAAGTTATTACTCAGGAAGCA<br>AAGAGGATTACA |
| SEQ ID NO: 66 | AAAATTCcatGCAAAATGCTCCGGTTTCATGTCATCAAAATGATGACGTAATTAAGCATTGATAATTGAGATCCCTCTCCCTGACAGGATGATTACATA<br>AATAATAGTGACAAAAATAAATTATTTATTTATCCAGAAAATGAATTGGAAAATCAGGAGAGCGTTTTCAATCCTACCTCTGGCGCAGTTGATATGTca<br>aaCAGGTtgccgtcactgcgtctttactggctcttctcgctaaccaaaccggtaacccgcgcttattaaaagcattctgtaacaaagcgggaccaaagc<br>catgacaaaaacgcgtaacaaaagtgtctataatcacggcagaaaagtccacattgattatttgcacggcgtcacactttgctatgccatagcatttt<br>atccataagattagcggatcctacctgacgcttttttatcgcaactctctactgtttctccataccgttttttgggctagcaccgcctatctcgtgtg<br>agataggcggagatacgaacttaagAAGGAGatataccatgGATAGTTTGAAAGATTTCACCAATCTGTACCCTGTCAGTAAGACATTGAGATTTGAA<br>TTAAAGCCGTTGGAAAGACTTTAGAAAATATCGAGAAGCAGGTATTTGAAAGAGGATGAGCATCGTGCAGAAAGTTATCGGAGGGTGAAGAAAATA<br>ATTGATACTTATCATAAGGTATTTATCGATTCTTCTCTTGAAAAATATGGCTAAAATGGGTATTGAGAATGAAATAAAAGCAATGCTCCAAAGTTTCTGC<br>GAATTGTATAAAAAAGATCATCGCACTGAGGGTGAAGACAAGGCATTAGATAAAATTCGAGCAGTACTTCGTGGCCTGATTGTTGGGGCTTCACTGGT<br>GTTTGCGGAAGACGGGAAAATACAGTCCAAAACGAGAAGTACGAAGTTGCTTCAAAGAAAAGTTGATAAAAGAAAATTTTACCTGATTTTGTGCTCT<br>ACTGAGGCTGAAAGCTTGCCTTTCTCTGTTGAAGAAGCTACGAGGTCACTGAAGGAGTTTGATAGCTTTACATCCTACTTTGCTGGTTTTTACGAGAAT<br>AGAAAGAATATATACTCGACGAAACCTCAATCCACTGCCATTGCTTATCGTCTTATTCATGAGAACTTGCCGAAGTTCATTGATAATATTCTTGTTTTT<br>CAGAAGATCAAAGAGCCTATAGCCAAAGAGCTGGAACATATTCGTGCGGACTTTTCTGCCGGGGGGTACATAAAAAGGATGAGAGATTGGAGGATATT<br>TTTTCGTTGAACTATTATATCCACGTGTTATCTCAGGCTGGGATCGAAAAATATAACGCATTGATTGGGAAGATTGTGACAGAAGGAGATGGAGAGATG<br>AAAGGGCTCAATGAACACATCAACCTTTACAACCAACAAAGAGGCAGAGAGGATCGGCTCCCTCTTTTAGGCCTCTTTATAAACAGATATTGAGTGAC<br>AGAGAGCAATTATCATACTTGCCTGAGAGTTTTGAAAAAGATGAGGAGCTCCTCAGGGCTCTAAAAGAGTTCTATGATCATATCGCAGAAGACATTCTC<br>GGACGTACTCAACAGTTGATGACTTCTATTTCAGAATATGATTTATCTCGGATATACGTAAGGAACGATAGCCAATTGACTGATATATCAAAAAAAATG<br>TTGGGAGATTGGAATGCATCTACATGGCTAGAGAACGAGCATATGACCAAAGAGATCTCCAAAAGAATCACGGCGAAATACGAGAGGACAGGATT<br>AAAGCTCTTAAAGGAGAAGAGAGTATAAGTCTGGCAAATCTTAATAGTTGTATTGCCTTTCTGGACAATGTTAGAGATTGCCGTGTAGATACTTATCTT<br>TCCACACTGGGCCAGAAGGAAGGACCACATGGTCTATCTAATCTCGTTGAGAACGTTTTTGCCTCATACCATGAAGCAGAGCAATTGTTGAGCTTTCCA<br>TACCCCGAAGAGAATAATCTGATTCAGGACAAGGACAATGTGGTGTTAATTAAGAATCTTCTCGACAATATCAGTGATCTGCAGAGGTTCTTGAAACCT<br>CTTTGGGGTATGGGAGACGAACCCGATAAAGATGAAGATTTTATGGAGAGTATAATTATATCCGAGGAGCTCTAGATCAGGTGATCCCTCTGTACAAT<br>AAGGTAAGGAACTACCTCACTCGGAAGCCTTATTCGACCAGAAAAGTAAAACTCAATTTTGGGAATTCTCAATTGCTTAGTGGTTGGGATAGAAATAAG<br>GAAAAGGATAATAGCTGTGTGATTTTGCGTAAGGGGCAGAACTTCTATTTGGCTATTATGAACAATAGGCACAAAAGAAGTTTCGAAAACAAGGTGTTG<br>CCCGAGTATAAGGAGGGAGAACCTTACTTCGAAAAGATGGATTATAAATTTTTGCCTGATCCTAATAAAATGCTTCCTAAGGTTTTTCTTTCGAAAAAA<br>GGAATAGAGATATACAAACCAAGTCCGAAGCTTTTAGAAGCATGGAAGTCACAAAAAAAGGGAGATCACAAAAAAGGGAGATGATTGCACGAA<br>CTGATCGATTTCTTCAAACACTCAATCGAGGCTCATGAAGATTGGAAGCAATTCGGATTCAAATTTTCTGATACGGCTACTTATGAGAATGTATCTAGT<br>TTCTATAGAGAAGTTGAGGATCAGGGGTATAAGCTCTCTTTCCGAAAAGTTTCGGAATCTTATGTCTATTCATTAATAGATCAAGGCAAGTTGTATTTA<br>TTTCAGATATACAACAAGGACTTTTCTCCCTGCAGCAAAGGGACACCTAATCTGCATACCTTGTATTGGAGAATGCTTTTTGACGAGCGCAATTTGGCA<br>GATGTCATATACAAACTGGATGGGAAGGCTGAAATCTTTTTCCGAGAGAAGAGTTTGAAAAATGATCATCCCACGCATCCGGCTGGTAAGCCTATCAAA<br>AGAAAAGTCGACAAAAAAAGGAGAGGAGAGTCTGTTTGAGTATGATTTAGTCAAGGATAGGCACTATACGATGGATAAGCTTCCAGTTTCATGTGCCT<br>ATTACTATGAATTTTAAATGTTCTGCAGGAAGCAAAGTCAATGATATGGTTAATGCTCATATTCGAGAGGCAAAGGATATGCATGTCATTGGAATTGAT<br>CGTGGAGAACGCAATCTGCTGTATATATGCGTGATAGATAGTCGAGGGACGATTTTGGATCAAATTTCTCTGAATACGATTAACGATATAGACTATCAT<br>GATTTATTGGAGAGTCGAGACAAAGACCGTCAGCAGGAGCGCCGAAACTGGCAAACTATCGAAGGGATCAAGGAGCTAAAACAAGGCTACCTTAGTCAG<br>GCGGTTCATCGGATAGCCGAACTGATGGTGCCTTATAAGGCTGTAGTTGCTTTGCTTTGGAGGATTTGAATATGGGGTTCAAACGTGGCGGCAGAAGTAGAA<br>AGTTCTGTTTATCAGCAGTTTGAGAAAGCTGATAGATAAGCTCAACTATCTTGTGGACAAGAAGAAAGGCTGAAGATATTGGAGGATTGTTGAGA<br>GCCTATCAATTTACGGCCCCATTTAAGAGTTTTAAGGAAATGGGAAAGCAAAACGGCTTCTTGTTTTATATCCCGGCTTGGAACACGAGCAACATAGAT<br>CCGACTACTGGATTTGTTAATTTATTTCATGCCCAGTATGAAAATGTAGATAAAGCGAAGAGCTTCTTTCAAAAGTTTGATTCAATTAGTTACAACCCG<br>AAGAAAGATCTGGTTTGAGTTTGCATTCGATTATAAAAACTTTACTAAAAAGGCTGAAGGAAGTCGTTCTATGTGGATTATTGCACACATGGTTCCCGA<br>ATAAAGAATTTTAGAAATTCCCAGAAGATGGTCAATGGGATTCCGAAGAATTCGCCTTGACGGAGGCTTTTAAGTCTCTTTTTGTGCGATATGAGATA<br>GATTATACCGCTGATTTGAAAACAGCTATTGTGGACGAAAAGCAAAAAGACTTCTTCGTGGATCTTCTGAAGCTATTCAAATTGACAGTACAGATGCGC<br>AACAGCTGGAAAGAGAAGGATTTGGATTATCTAATCTCTCCTGTAGCAGGGGCTGATGGCCGTTCTTCGATCAAGAGAGGGAAATAAAGTCTGCCT<br>AAGGATGCAGATGCCAATGGAGCTTATAATTATTGCCCTAAAAGGACTTTGGCCTCTACGCCAGATTCGGCAAACTTCAGAAGGCGTAAACTCAATTG<br>GCGATTTCCAATAAGGAATGGCTACAGTTTGTGCAAGAAGATCTTACGAGAAAGACtgAAAATCATCCTTAGCGAAAGCTAAGGATTTTTTTTTATCT<br>GAAATTTATTATATCGCGTTGATTATTGATGCTGTTTTTAGTTTTAACGGCAATTAATATGTGTTATTAATTGAATGAATTTTATCATTCATAATAA<br>GTATGTGTAGGATCAAGCTCAGGTTAAATATTCACTCAGGAAGTTATTACTCAGGAAGCAAAGAGGATTACAGAATTATCTCATAACAAGTGTTAAGGG<br>ATGTTATTCC |
| SEQ ID NO: 67 | AAAATTCcatGCAAAATGCTCCGGTTTCATGTCATCAAAATGATGACGTAATTAAGCATTGATAATTGAGATCCCTCTCCCTGACAGGATGATTACATA<br>AATAATAGTGACAAAAATAAATTATTTATTTATCCAGAAAATGAATTGGAAAATCAGGAGAGCGTTTTCAATCCTACCTCTGGCGCAGTTGATATGTca<br>aaCAGGTtgccgtcactgcgtctttactggctcttctcgctaaccaaaccggtaacccgcgcttattaaaagcattctgtaacaaagcgggaccaaagc<br>catgacaaaaacgcgtaacaaaagtgtctataatcacggcagaaaagtccacattgattatttgcacggcgtcacactttgctatgccatagcatttt |

TABLE 5-continued

| SEQ ID NO | Sequence |
|---|---|
| | atccataagattagcggatcctacctgacgcttttttatcgcaactctctactgtttctccatacccgttttttgggctagcaccgcctatctcgtgtg<br>agataggcggagatacgaactttaagAAGGAGatataccATGAACAACGGCACAAATAATTTTCAGAACTTCATCGGGATCTCAAGTTTGCAGAAAACG<br>CTGCGCAATGCTCTGATCCCCACGGAAACCACGCAACAGTTCATCGTCAAGAACGGAATAATTAAAGAAGATGAGTTACGTGGCGAGAACCGCCAGATT<br>CTGAAAGATATCATGGATGACTACTACCGCGGATTCATCTCTGAGACTCTGAGTTCTATTGATGACATAGATTGGACTAGCCTGTTCGAAAAAATGGAA<br>ATTCAGCTGAAAATGGTGATAATAAAGATACCTTAATTAAGGAACAGACAGAGTATCGGAAAGCAATCCATAAAAAATTTGCGAACGACGATCGGTTT<br>AAGAACATGTTTAGCGCCAAACTGATTAGTGACATATTACCTGAATTTGTCATCCACAACAATAATTATTCGGCATCAGAGAAAGAGGAAAAACCCAG<br>GTGATAAAATTGTTTCGCGCTTTGCGACTAGCTTTAAAGATTACTTCAAGAACCGTGCAAATTGCTTTTCAGCGGACGATATTTCATCAAGCAGCTGC<br>CATCGCATCGTCAACGACAATGCAGAGATATTCTTTTCAAATGCGCTGGTCTACCGCCGGATCGTAAAATCGCTGAGCAATGACGATATCAACAAATT<br>TCGGGCGATATGAAAGATTCATTAAAAGAAATGAGTCTGGAAGAAATATATTCTTACGAGAAGTATGGGGAATTTATTACCCAGGAAGGCATTAGCTTC<br>TATAATGATATCTGTGGGAAAGTGAATTCTTTTATGAACCTGTATTGTCAGAAAAATAAAGAAAACAAAAATTTATACAAACTTCAGAAACTTCACAAA<br>CAGATTCTATGCATTGCGGACACTAGCTATGAGGTCCCGTATAAATTTGAAAGTGACGAGGAAGTGTACCAATCAGTTAACGGCTTCCTTGATAACATT<br>AGCAGCAAACATATAGTCGAAAGATTACGCAAAATCGGCGATAACTATAACGGCTACAACCTGGATAAAATTTATATCGTGTCCAAATTTTACGAGAGC<br>GTTAGCCAAAAAACCTACCGCGACTGGGAAACAATTAATACCGCCCTCGAATTTCATTACAATAATATCTTGCCGGGTAACGGTAAAGTAAAGCCGAC<br>AAAGTAAAAAAAGCGGTTAAGAATGATTTACAGAAATCCATCACCGAAATAAATGAACTAGTGTCAAACATATAAGCTGTGCAGTGACGACAACATCAAA<br>GCGGAGACTTATATACATGAGATTAGCCATATCTTGAATAACTTTGAAGCACAGGAATTGAAATACAATCCGGAAATTCACCTAGTTGAATCCGAGCTC<br>AAAGCGAGTGAGCTTAAAAACGTGCTGGACGTGATCATGAATGCGTTTCATTGGTGTTCGGTTTTATGACTGAGGAACTTGTTGATAAAGACAACAAT<br>TTTTATGCGGAACTGGAGGAGATTTACGATGAAATTTATCCAGTAATTAGTCTGTCAACCTGGTTCGTAACTACGTTACCCAGAAACCGTACAGCACG<br>AAAAAGATTAAATTGAACTTTGGAATACCGACGTTAGCAGACAGGTTGGTCAAAGTCCAAAGAGTATTCTAATAACGCTATCATACTGATGCGCGACAAT<br>CTGTATTATCTGGGCATCTTTAATGCGAAGAATAAACCGGACAAGAAGATTATCGAGGGTAATACGTCAGAAAATAAGGGTGACTACAAAAGATGATT<br>TATAATTTGCTCCCGGGTCCCAACAAAATGATCCCGAAAGTTTTCTTGAGCAGCAAGACGGGGGTGGAAACGTATAAACCGAGCGCCTATATCCTAGAG<br>GGGTATAAACAGAATAAACATATCAAGTCTTCAAAAGACTTTGATCACTTTCTGTCATGATCTGATCGACTACTTCAAAAACTGTATTGCAATTCAT<br>CCCGAGTGGAAAAACTTCGGTTTTGATTTTAGCGACACCAGTACTTATGAAGACATTTCCGGGTTTTATCGTGAGGTAGAGTTACAAGGTTACAAGATT<br>GATTGGACATACATTAGCGAAAAAGACATTGATCTGCTGCAGGAAAAAGGTCAACTGTATCTGTTCCAGATATATAACAAAGATTTTTCGAAAAAATCA<br>ACCGGGAATGACAACCTTCACACCATGTACCTGAAAAATCTTTTCTCAGAAGAAAATCTTAAGGATATCGTCCTGAAACTTAACGGCGAAGCGGAAATC<br>TTCTTCAGGAAGAGCAGCATTACGAGAACCCAATCATTCATAAAAAAGGCTCGATTTTAGTCAACCGTACCTACGAAGCAGAAGAAAAAGACCAGTTTGGC<br>AACATTCAAATTGTGCGTAAAAATATTCCGGAAAACATTTATCAGGAGCTGTACAAATACTTCAACGATAAAAGCGACAAAGAGCTGTCTGATGAAGCA<br>GCCAAACTGAAGAATGTAGTGGGACACCACGAGGCAGCGACGAATATAGTCAAGGACTATCGCTACACGTATGATAAATACTTCCTTCATATGCCTATT<br>ACGATCAATTTCAAAGCCAATAAAACGGGTTTTATTAATGATAGGATCTTACAGTATATCGCTAAAGAAAAAGACTTACATGTGATCGGCATTGATCGG<br>GGCGAGCGTAACCTGATCTACGTGTCCGTGATTGATACTTGTGGTAATATAGTTGAACAGAAAAGCTTTAACATTGTAAACGGCTACGACTATCAGATA<br>AAACTGAAACAACAGGAGGCGCTAGACAGATTGCGCGGAAAGAATGGAAAGAAATTGGTAAAATTAAAGAGATCAAAGAGGGCTACCTGAGCGTAGTA<br>ATCCACGAGATCTCTAAAATGGTAATCAAATACAATGCAATTATAGCGATGAGGATTTGTCTTATGGTTTTAAAAAGGGCGCTTTAAGGTCGAACGG<br>CAAGTTTACCAGAAATTTGAAACCATGCTCATCAATAAACTCAACTATCGGTATTTAAAGATATTTCGATTACCGAGAATGGCGGTCTCCTGAAAGGT<br>TATCAGCTGACATACATTCCTGATAAACTTAAAAACGTGGGTCATCAGTGCGGCTGCATTTTTTATGTGCCTGCTGCATACACGAGCAAATTGATCCG<br>ACCACCGGCTTTGTGAATATCTTTAAATTTAAAGACCTGACAGTGACGCAAAACGTGAATTCATTAAAAAATTGACTCAATTCGTTATGACAGTGAA<br>AAAAATCTGTTCTGCTTTACATTTGACTACAATAACTTTATTACGCAAAACACGGTCATGAGCAAATCATCGTGGAGTGTGTATACATACGGCGTGCGC<br>ATCAAACGTCGCTTTGTGAACGGCCGCTTCTCAAACGAAAGTGATACCATTGACATAACCAAAGATATGGAGAAAACGTTGGAAATGACGGACATTAAC<br>TGGCGCGATGGCCACGATCTTCGTCAAGACATTATAGATTATGAAATTGTTCAGCACATATTCGAAATTTTCCGTTTAACAGTGCAAATGCGTAACTCC<br>TTGTCTGAACTGGAGGACCGTGATTACGATCGTCTCATTTCACCTGTACTGAACAGAAATAACATTTTTTATGACAGCGCGAAAGCGGGGATGCACTT<br>CCTAAGGATGCCGATGCAAATGGTGCGTATTGTATTGCATTAAAAGGGTTATATGAAATTAAACAAATTACCGAAAATTGGAAAGAAGATGTAAATTT<br>TCGCGCGATAAACTCAAAATCAGCAATAAAGATTGGTTCGACTTTATCCAGAATAAGCGCTATCTCTAAGAAATCATCCTTAGCGAAAGCTAAGGATTT<br>TTTTTATCTGAAATTTATTATATCGCGTTGATTATTGATGCTGTTTTTAGTTTTAACGGCAATTAATATATGTGTTATTAATTGAATGAATTTTATCAT<br>TCATAATAAGTATGTGTAGGATCAAGCTCAGGTTAAATATTCACTCAGGAAGTTATTACTCAGGAAGCAAAGAGGATTACAGAATTATCTCATAACAAG<br>TGTTAAGGGATGTTATTTCC |
| SEQ ID NO: 68 | AATCAGGAGAGCGTTTTCAATCCTACCTCTGGCGCAGTTGATATGTCAAACAGGTTGCCGTCACTGCGTC<br>TTTTACTGGCTCTTCTCGCTAACCAAACCGGTAACCCGCTATTAAAAGCATTCTGTAACAAAGCGGGA<br>CCAAAGCCATGACAAAAACGCGTAACAAAAGTGTCTATAATCACGGCAGAAAAGTCCACATTGATTATT<br>TGCACGGCGTCACACTTTGCTATGCCATAGCATTTTTATCCATAAGATTAGCGGATCCTACCTGACGCTT<br>TTTATCGCAACTCTCTACTGTTTCTCCATACCCGTTTTTTGGGCTAGCAGTAATACGACTCACTATAGGG<br>GTCTCATCTCGTGTGAGATAGGCGGAGATACGAACTTTAAGAGGAGATATACCATGCACCATCATCAT<br>CACCATACCAATAAATTCACTAACCAGTATTCTCTCTCTAAGACCCTGCGCTTTGAACTGATTCCGCAGG<br>GGAAAACCTTGGAGTTCATTCAAGAAAAGGCCTCTTGTCTCAGGATAAACAGAGGGCTGAATCTTACC<br>AAGAAATGAAGAAACTATTGATAAGTTTCATAAATATTTCATTGATTTAGCCTTGTCTAACGCCAAATT<br>AACTCACTTGGAAACGTATCTGGAGTTTATACAACAAATCTGCCGAAACTAAGGAAAAGAAAGAAATTTAA<br>AGACGATTTGAAAAAGTACAGGACAATCTGCGTAAAGAAATTGTCAAATCCTTCAGTGACGGCGATGC<br>TAAAAGCATTTTTGCCATTCTGGACAAAAAGAGTTGATTACTGTGGAATTAGAAAGTGGTTTGAAAA<br>CAATGAGCAGAAAGACATCTACTTCGATGAGAAATTCAAAACTTTCACCACCTATTTTACAGGATTTCAT<br>CAAAACCGGAAGAACATGTACTCAGTAGAACCGAACTCCACGGCCATTGCGTATCGTTTGATCCATGAG<br>AATCTGCCTAAATTTCTGGAGAATGCGAAAGCCTTTGAAAAGATTAAGCAGTCGAATCGCTGCAAGTG<br>AATTTTCGTGAACTCATGGGCGAATTTGGTGACGAAGGTCTAATCTTCGTTAACGAACTGGAAGAAATG<br>TTTCAGATTAATTACTACAATGACGTGCTATCGCAGAACGGTATCACAATCTACAATAGTATTATCTCAG<br>GGTTCACAAAAAACGATATAAAATACAAAGGCCTGAACGAGTATATCAATAACTACAACCAAACAAAG<br>GACAAAAAGGATAGGCTTCCGAAACTGAACGAGTTATACAAACAGATTTTATCTGACAGATCTCCCTG<br>AGCTTTCTGCCGGATGCTTTCACTGATGGGAAGCAGGTTCTGAAAGCGATTTTCGATTTTTATAAGATTA<br>ACTTACTGAGCTACACGATTGAAGGTCAAGAAGAATCTCAAAACTTACTGCTCTTGATCCGTCAAACCAT<br>TGAAAATCTATCATCGTTCGATACGCAGAAAATCTACCTCAAAAACGATACTCACCTGACTACGATCTCT<br>CAGCAGGTTTTCGGGGATTTTAGTGTATTTTCAACAGCTCTGACTACTTGGTATGAAACCAAAGTCAATC<br>CGAAATTCGAGCGGAATATTCTAAGGCCAACGAAAAAAAACGTGAGATTCTTGATAAAGCTAAAGCC<br>GTATTTACTAAACAGGATTACTTTTCTATTGCTTTCCTGCAGGAAGTTTATCGGAGTATATCCTGACCCT<br>GGATCATACATCTGATATCGTTAAAAAACACAGCAGCAATTGCATCGCTGACTATTTCAAAAACCACTTT<br>GTCGCCAAAAAGAAAACGAAACAGACAAGACTTTCGATTTCATTGCTAACATCACCGCAAAATACCAG<br>TGTATTCAGGGTATCTTGGAAAACGCCGACCAATACGAAGACGAACTGAAACAAGATCAGAAGCTGATC<br>GATAATTTAAAATTCTTCTTAGATGCAATCCTGGAGCTGCTGCACTTCATCAAACCGCTTCATTTAAAGA<br>GCGAGTCCATTACCGAAAGGACACCGCCTTCTATGACGTTTTGAAATTATTATGAAGCCCTCTCCTT<br>GCTGACTCCGCTGTATAATATGGTACGCAATTACGTAACCCAGAAACCATATTCTACCGAAAAATTAA<br>ACTGAACTTTGAAAACGCACAGCTGCTCAACGGTTGGGACGCGAATAAAGAAGGTGACTACCTCACCAC |

TABLE 5-continued

| SEQ ID NO | Sequence |
|---|---|
| | CATCCTGAAAAAAGATGGTAACTATTTTCTGGCAATTATGGATAAGAAACATAATAAAGCATTCCAGAA<br>ATTTCCTGAAGGGAAAGAAAATTACGAAAAGATGGTGTACAAACTCTTACCTGGAGTTAACAAAATGTT<br>GCCGAAAGTATTTTTTAGTAATAAGAACATCGCGTACTTTAACCCGTCCAAAGAACTGCTGGAAAATTAT<br>AAAAAGGAGACGCATAAGAAAGGGGATACCTTTAACCTGGAACATTGCCATACCTTAATAGACTTCTTC<br>AAGGATTCCCTGAATAAACACGAGGATTGGAAATATTTCGATTTTCAGTTTAGTGAGACCAAGTCATAC<br>CAGGATCTTAGCGGCTTTTATCGCGAAGTAGAACACCAAGGCTATAAAATTAACTTCAAAAACATCGAC<br>AGCGAATACATCGACGGTTTAGTTAACGAGGGCAAACTGTTTCTGTTCCAGATCTATTCAAAGGATTTTA<br>GCCCGTTCTCTAAAGGCAAACCAAATATGCATACGTTGTACTGGAAAGCACTGTTTGAAGAGCAAAACC<br>TGCAGAATGTGATTTATAAACTGAACGGCCAAGCTGAGATTTTTTTCCGTAAAGCCTCGATTAAACCGAA<br>AAATATCATCCTTCATAAGAAGAAAATAAAGATCGCTAAAAAACACTTCATAGATAAAAAACCAAAA<br>CCTCCGAAATAGTGCCTGTTCAAACAATTAAGAACTTGAATATGTACTACCAGGGCAAGATATCGGAAA<br>AGGAGTTGACTCAAGACGATCTTCGCTATATCGATAACTTTTCGATTTTTAACGAAAAAAACAAGACGA<br>TCGACATCATCAAAGATAAACGCTTCACTGTAGATAAGTTCCAGTTTCATGTGCCGATTACTATGAACTT<br>CAAAGCTACCGGGGGTAGCTATATCAACCAAACGGTTGTTGGAATACCTGCAGAATAACCCGGAAGTCAA<br>AATCATTGGGCTGGACCGCGGAGAACGTCACCTTGTGTACTTGACCTTAATCGATCAGCAAGGCAACAT<br>CTTAAAACAAGAATCGCTGAATACCATTACGGATTCAAAGATTAGCACCCCGTATCATAAGCTGCTCGA<br>TAACAAGGAGAATGAGCGCGACCTGGCCCGTAAAAACTGGGGCACGGTGGAAACATTAAGGAGTTAA<br>AGGAGGGTTATATTTCCCAGGTAGTGCATAAGATCGCCACTCTCATGCTCGAGGAAAATGCGATCGTTG<br>TCATGGAAGACTTAAACTTCGGATTTAAACGTGGGCGATTTAAAGTAGAGAAACAAATCTACCAGAAGT<br>TAGAAAAAATGCTGATTGACAAATTAAATTACTTGGTCCTAAAAGACAAACAGCCGCAAGAATTGGGTG<br>GATTATACAACGCCCTCCAACTTACCAATAAATTCGAAAGTTTTCAGAAAATGGGTAAACAGTCAGGCT<br>TTCTTTTTTATGTTCCTGCGTGGAACACATCCAAAATCGACCCTACAACCGGCTTCGTCAATTACTTCTAT<br>ACTAAATATGAAAACGTCGACAAAGCAAAAGCATTCTTTGAAAAGTTCGAAGCAATACGTTTTAACGCT<br>GAGAAAAAATATTTCGAGTTCGAAGTCAAGAAATACTCAGACTTTAACCCCAAAGCTGAGGGCACACAG<br>CAAGCGTGGACAATCTGCACCTACGGCGAGCGCATCGAAACGAAGCGTCAAAAAGATCAGAATAACAA<br>ATTTGTTTCAACACCTATCAACCTGACCGAGAAGATTGAAGACTTCTTAGGTAAAAATCAGATTGTTTAT<br>GGCGACGGTAACTGTATAAAATCTCAAATAGCCTCAAAGGATGATAAAGCATTTTTCGAAACATTATTA<br>TATTGGTTCAAAATGACACTGCAGATGCGCAATAGTGAGACGCGTACAGATATTGATTATCTTATCAGCC<br>CGGTCATGAACGACAACGGTACTTTTTACAACTCCAGAGACTATGAAAAACTTGAGAATCCAACTCTCC<br>CCAAAGATGCTGATGCGAACGGTGCTTATCACATCGCGAAAAAAGGTCTGATGCTGCTGAACAAAATCG<br>ACCAAGCCGATCTGACTAAGAAAGTTGACCTAAGCATTTCAAATCGGGACTGGTTACAGTTTGTTCAAA<br>AGAACAAATGAGAAATCATCCTTAGCGAAAGCTAAGGATTTTTTTTATCTGAAATGTAGGGAGACCCTC<br>AGGTTAAATATTCACTCAGGAAGTTATTACTCAGGAAGCAAAGAGGATTACA |
| SEQ ID NO: 69 | AAAATTCcatGCAAAATGCTCCGGTTTCATGTCATCAAAATGATGACGTAATTAAGCATTGATAATTGAGATCCCTCTCCCTGACAGGATGATTACATA<br>AATAATAGTGACAAAAATAAATTATTTATTTATCCAGAAAATGAATTGGAAATCAGGAGAGCGTTTTCAATCCTACCTCTGGCGCAGTTGATATGTca<br>aaCAGGTtgccgtcactgcgtctttttactggctcttctcgctaaccaaaccggtaacccgcgcttattaaaagcattctgtaacaaagcgggaccaaagc<br>catgacaaaaacgcgtaacaaaagtgtctataatcacggcagaaaagtccacattgattatttgcacggcgtcacactttgctatgccatagcattttt<br>atccataagattagcggatcctacctgacgcttttttatcgcaactctctactgtttctccataccgtttttttgggctagcaccgcctatctcgtgtg<br>agataggcggagatacgaactttaagAAGGAGatataccATGGAACAGGAATATTATCTGGGCTTGGACATGGGCACCGGTTCCGTCGGCTGGGCTGTT<br>ACTGACAGTGAATATCACGTTCTAAGAAAGCATGGTAAGGCATTGTGGGGTGTAAGACTTTTCGAATCTGCTTCCACTGCTGAAGAGCGTAGAATGTTT<br>AGAACGAGTCGACGTAGGCTAGACAGGCGCAATTGGAGAATCGAAATTTTTACAAGAAATTTTTGCGGAAGAGATATCTAAGAAAGACCCAGGCTTTTTC<br>CTGAGAATGAAGGAATCTAAGTATTACCCTGAGGATAAAAGAGATATAAATGGTAACTGTCCCGAATTGCCTTACGCATTATTTGTGGACGATGATTTT<br>ACCGATAAGGATTACCATAAAAAGTTCCCAACTATCTACCATTTACGCAAAATGTTAATGAATACAGAGGAAACCCAGACATAAGACTAGTTTATCTG<br>GCAATACACCCATATGATGAAACATAGAGGCCATTTCTTACTTTCCGGGGATATCAACGAAATCAAAGAGTTTGGTACCACATTTAGTAAGTTACTGGAA<br>AACATAAAGAATGAAGAATTGGATTGGAACTTAGAACTCGGAAAGAAGAATAACGCGGTTGTCGAATATCTGACTAAGGAAGAATATAAAGATCTGAATAGGTCG<br>ACCAAAAAAACTAGGCTGATCAAAGCACTGAAAGCCAAATCTATCTGCGAAAAAGCTGTTTTAAATTTACTTGCTGGTGGCACTGTTAAGTTATCAGAC<br>ATTTTTGGTTTGGAAGAATTGAACGAAACCGAGCGTCCAAAAATTAGTTTCGCTGATAATGGCTACGATGATTACATTGGTGAGGTGGAAAACGAGTTG<br>GGCGAACAATTTTATATTATAGAGACAGCTAAGGCAGTCTATGACTGGGCTGTTTTAGTAGAAATCCTTGGTAAATACACATCTATCTCCGAAGCGAAA<br>GTTGCTACTTACGAAAAGCACAAGTCCGATCTCCAGTTTTTGAAGAAATCTGCAGGAAATATCTGACTAAGGAAGAATATAAAGATATTTTCGTTAGT<br>ACCTCTGACAAACTGAAAAATTACTCCGCTTACATCGGGATGACCAAGATTAATGGCAAAAAAGTTGATCTGCAAAGCAAAAGGTGTTCGAAGGAAGAA<br>TTTTATGATTTCATTAAAAAGAATGTCTTAAAAAAATTAGAAGGTCAGCCAGAATACGAATATTGAAAGAAGAACTGGAAAGAGAGCATTCTTACCA<br>AAACAAGTCAACAGAGATAATGGGGTAATTCCATATCAAATTCACCTCTACGAATTAAAAAAAAATTTTAGGCAATTTACGCGATAAAATTGACCTTATC<br>AAAGAAAATGAGGATAAGCTGGTTCAACTCTTTGAATTCAGAATACCCTATTATGTGGGGCCCACTGAACAAGATTGATGACGGCAAAGAAGGTAAATTC<br>ACATGGGCCGTCCGCAAATCCAATGAAAAAATTTACCCATGGAACTTTGAAAATGTAGTAGATATTGAAGCGTCTGCGGAGAAATTTATTCGAAGAATG<br>ACTAATAAATGCACTTACTTCGATGGGAGAGGATGTTCTGCCTAAAGACAGCTTATTATACAGCAAGTACATGGTTCTAAACGAACTTAACAACGTTAAG<br>TTGGACGGTGAGAAATTAAGTGTAGAATTGAAACAAAGATTGTATACTGACGTCTTCTGCAAGTACAGAAAGTGACAGTTAAAAAAATTAAGAATTAC<br>TTGAAGTGCGAAGGTATAATTTCTGGAAACGTAGAGATTACTGGTATTGATGGTGATTTCAAAGCATCCCTAACAGCTTACCACGATTTCAAGGAAATC<br>CTGACAGGAACTGAACCTGCAAAAAAAGATAAAGAAAACATTATTCTAATATTGTTCTTTTCGGTGATGACAAGAAATTGTTGAAGAAAAGACTGAAT<br>AGACTTTACCCCCAGATTACTCCCAATCAACTTAAGAAAATTTGTGCTTTGTCTTACACAGGATGGGGTCGTTTTTCAAAAAAGTTCTTAGAAGAGATT<br>ACCGCACCTGATCCAGAAACAGGCGAAGTATGGAATATAATTACCGCCTTATGGGAATCGAACAATAATCTTATGCAACTTCTGAGCAATGAATATCGT<br>TTCATGGAAGAAGTTGAGACTTACAACATGGGCAAACAGACGAAGACTTTATCCTATGAAACTGTGGAAAATATGTATGTATCACCTTCTGTCAAGAGA<br>CAAATTTGGCAAACCTTAAAAATTGTCAAGAATTAGAAAAAGGTAATGAAGGAGTCTCCTAAACGTGGTGTTTATTGAAATGGCTAGAGAAAACAAGAG<br>TCAAAAAGAACCGAGTCAAGAAAGAAGCAGTTAATCGATTTATATAAGGCTTGTAAAACGAAGAGAAAGATTGGGTAAAGAATTGGGGGACCAAGAG<br>GAACAAAAACTACGGTCGGATAAGTTGTATTTATACTATACGCAAAAGGGACGATGTATGTATTCCGGCGAGGTAATAGAATTGAAGGATTTATGGGAC<br>AATACAAAATATGACATAGACCATATATATCCCCAATCAAAAACGATGGACGATAGCTTGAACAATAGAGTACTCGTGAAAAAAAAATATAATGCGACC<br>AAATCTGATAAGTATCCTCTGAATGAAAAATATCAGACATGAAGAAAAGGGGTTCTGGAAGTCCTTGTTAGATGGTGGGTTTATAAGCAAAGAAAAAGTAC<br>GAGCGTCTAATAAGAACACGGAGTTATCGCCAGAAGAACTCGCTGGTTCTTATTGAGAGGCAAATCGTGGAAACGAGACAATCTACCAAAGCCGTTGCT<br>GAGATCCTAAAGCAAGTTTTCCCAGAGTCGGAGATTGTCTATGTCAAAGCTGGCACAGTGAGCAGGTTAGGAAAGACTTCGAACTATTAAAGGTAAGA<br>GAAGTGAACGATTTACATCACGCAAAGGACGCTTACCTAAATATCGTTGTAGGTAACTCATATTATGTTAAATTTACCAAGAACGCCTCTTGGTTTATA<br>AAGGGAACCCAGGTAGACATATAACCTAGAAAAATGTTCACCTCTGGTTGGAATATTGAGAGAAACGGAAGTCGCATGGAATTGGTAAGAAA<br>GGGACTATAGTGACAGTAAAGCAAATTATGAACAAAAATAATATCCTCGTTACAAGGCAGGTTCATGAAGCAAAGGCGGCCTTTTTGACCAACAAATT<br>ATGAAGAAAGGGAAAGTCAAATTGCAATAAAAGAAACCGATGCGAGACTAGCGTCAATAGAAAGTATGGTGGCTATAATAAAGCTGCGGTGCATAC<br>TTTATGCTTGTTGAATCAAAAGACAAGAAAGGTAAGACTATTAGAACTATAGAATTTATACCCCTGTACCTTAAAAACAAAATTGAATCGGATGAGTCA<br>ATCGCGTTAAATTTTCTAGAGAAAGGAAGGGGTTTAAAAGAACCAAAGATCCTGTTAAAAAAGATTAAGATTGACACCTTGTTCGATGTAGATGGATTT<br>AAAATGTGGTTATCTGGCAGAACAGGCGATAGACTTTTGTTTAAGTGCGCTAATCAATTAATTTTTGGATGAGAAAATCATTGTCACAATGAAAAAAATA |

TABLE 5-continued

| SEQ ID NO | Sequence |
|---|---|
| | GTTAAGTTTATTCAGAGAAGACAAGAAAACAGGGAGTTGAAATTATCTGATAAAGATGGTATCGACAATGAAGTTTTAATGGAAATCTACAATACATTC<br>GTTGATAAACTTGAAAATACCGTATATCGAATCAGGTTAAGTGAACAAGCCAAAACATTAATTGATAAACAAAAAGAATTTGAAAGGCTATCACTGGAA<br>GACAAATCCTCCACCCTATTTGAAATTTTGCATATATTCCAGTGCCAATCTTCAGCAGCTAATTTAAAAATGATTGGCGGACCTGGGAAAGCCGGCATC<br>CTAGTGATGAACAATAATATCTCCAAGTGTAACAAAATATCAATTATTAACCAATCTCCGACAGGTATTTTTGAAAATGAAATAGACTTGCTTAAGATA<br>TAAGAAATCATCCTTAGCGAAAGCTAAGGATTTTTTTTATCTGAAATTTATTATATCGCGTTGATTATTGATGCTGTTTTTAGTTTTAACGGCAATTAA<br>TATATGTGTTATTAATTGAATGAATTTTATCATTCATAATAAGTATGTGTAGGATCAAGCTCAGGTTAAATATTCACTCAGGAAGTTATTACTCAGGAA<br>GCAAAGAGGATTACAGAATTATCTCATAACAAGTGTTAAGGGATGTTATTTCC |
| SEQ ID NO: 70 | AATCAGGAGAGCGTTTTCAATCCTACCTCTGGCGCAGTTGATATGTCAAACAGGTTGCCGTCACTGCGTC<br>TTTTACTGGCTCTTCTCGCTAACCAAACCGGTAACCCCGCTTATTAAAAGCATTCTGTAACAAAGCGGGA<br>CCAAAGCCATGACAAAAACGCGTAACAAAAGTGTCTATAATCACGGCAGAAAAGTCCACATTGATTATT<br>TGCACGGCGTCACACTTTGCTATGCCATAGCATTTTTATCCATAAGATTAGCGGATCCTACCTGACGCTT<br>TTTATCGCAACTCTCTACTGTTTCTCCATACCCGTTTTTTTGGGCTAGCAGTAATACGACTCACTATAGGG<br>GTCTCATCTCGTGTGAGATAGGCGGAGATACGAACTTTAAGAGGAGGATATACCATGCACCATCATCAT<br>CACCATTCTTTCGACTCTTTCACCAACCTGTACTCTCTGTCTAAAACCCTGAAATTCGAAATGCGTCCGGT<br>TGGTAACACCCAGAAAATGCTGGACAACGCGGGTGTTTTCGAAAAAGACAAACTGATCCAGAAAAAAT<br>ACGGTAAAACCAAACCGTACTTCGACCGTCTGCACCGTGAATTCATCGAAGAAGCGCTGACCGGTGTTG<br>AACTGATCGGTCTGGACGAAAACTTCCGTACCCTGGTTGACTGGCAGAAAGACAAAAAAAACAACGTTG<br>CGATGAAAGCGTACGAAACTCTCTGCAGCGTCTGCGTACCGAAATCGGTAAAATCTTCAACCTGAAAG<br>CGGAAGACTGGGTTAAAAACAAATACCCGATCCTGGGTCTGAAAAACAAAAACACCGACATCCTGTTCG<br>AAGAAGCGGTTTTCGGTATCCTGAAAGCGCGTTACGGTGAAGAAAAAGACACCTTCATCGAAGTTGAAG<br>AAATCGACAAAACCGGTAAATCTAAAATCAACCAGATCTCTATCTTCGACTCTTGGAAAGGTTTCACCG<br>GTTACTTCAAAAAATTCTTCGAAACCCGTAAAAACTTCTACAAAAACGACGGTACCTCTACCGCGATCG<br>CGACCCGTATCATCGACCAGAACCTGAAACGTTTCATCGACAACCTGTCTATCGTTGAATCTGTTCGTCA<br>GAAAGTTGACCTGGCGGAAACCGAAAAATCTTTCTCTATCTCTGTCTCAGTTCTTTCTCTATCGACTTCT<br>ACAACAAATGCCTGCTGCAGGACGGTATCGACTACTACAACAAAATCATCGGTGGTGAAACCCTGAAAA<br>ACGGTGAAAAACTGATCGGTCTGAACGAACTGATCAACCAGTACCGTCAGAACAACAAAGACCAGAAA<br>ATCCCGTTCTTCAAACTGCTGGACAAACAGATCCTGTCTGAAAAAATCCTGTTCCTGGACGAAATCAAA<br>AACGACACCGAACTGATCGAAGCGCTGTCTCAGTTCGCGAAAACGCGGAAGAAAAACCAAAATCGT<br>TAAAAAACTGTTCGCGGACTTCGTTGAAAACAACTCTAAATACGACCTGGCGCAGATCTACATCTCTCA<br>GGAAGCGTTCAACACCATCTCTAACAAATGGACCTCTGAAACCGAAACCTTCGCGAAATACCTGTTCGA<br>AGCGATGAAATCTGGTAAACTGGCGAAATACGAAAAAAAAGACAACTCTTACAAATTCCCGGACTTCAT<br>CGCGCTGTCTCAGATGAAATCTGCGCTGCTGTCTATCTCTCTGGAAGGTCACTTCTGGAAAGAAAAATAC<br>TACAAAATCTCTAAATTCCAGGAAAAAAACCAACTGGGAACAGTTCCTGGCGATCTTCCTGTACGAATTC<br>AACTCTCTGTTCTCTGACAAAATCAACACCAAAGACGGTGAAACCAAACAGGTTGGTTACTACCTGTTC<br>GCGAAAGACCTGCACAACCTGATCCTGTCTGAACAGATCGACATCCCGAAAGACTCTAAAGTTACCATC<br>AAAGACTTCGCGGACTCTGTTCTGACCATCTACCAGATGGCGAAATACTTCGCGGTTGAAAAAAAACGT<br>GCGTGGCTGGCGGAATACGAACTGGACTCTTTCTACACCCAGCCGGACACCGGTTACCTGCAGTTCTAC<br>GACAACGCGTACGAAGACATCGTTCAGGTTTACAACAAACTGCGTAACTACCTGACCAAAAACCGTAC<br>TCTGAAGAAAATGGAAACTGAACTTCGAAACTCTACCCTGGCGAACGGTTGGGACAAAACAAAGA<br>ATCTGACAACTCTGCGGTTATCCTGCAGAAAGGTGGTAAATACTACCTGGGTCTGATCACCAAAGGTCA<br>CAACAAAATCTTCGACGACCGTTTCCAGGAAAAATTCATCGTTGGTATCGAAGGTGGTAAATACGAAAA<br>AATCGTTTACAAATTCTTCCCGGACCAGGCGAAAATGTTCCCGAAAGTTTGCTTCTCTGCGAAAGGTCTG<br>GAATTCTTCCGTCCGTCTGAAGAAATCCTGCGTATCTACAACAACGCGGAATTCAAAAAAGGTGAAACC<br>TACTCTATCGACTCTATGCAGAAACTGATCGACTTCTACAAAGACTGCCTGACCAAATACGAAGGTTGG<br>GCGTGCTACACCTTCCGTCACCTGAAACCGACCGAAGAATACCAGAACAACATCGGTGAATTCTTCCGT<br>GACGTTGCGGAAGACGGTTACCGTATCGACTTCCAGGGTATCTCTGACCAGTACATCCACGAAAAAAAC<br>GAAAAAGGTGAACTGCACCTGTTCGAAATCCACAACAAAGACTGGAACCTGGACAAAGCGCGTGACGG<br>TAAATCTAAAACCACCCAGAAAAAACCTGCACACCCTGTACTTCGAATCTCTGTTCTCTAACGACAACGTT<br>GTTCAGAACTTCCCGATCAAACTGAACGGTCAGGCGGAAATCTTCTACCGTCCGAAAACCGAAAAAGAC<br>AAACTGGAATCTAAAAAAGACAAAAAAGGTAACAAAGTTATCGACCACAAACGTTACTCTGAAAACAA<br>AATCTTCTTCCACGTTCCGCTGACCCTGAACCGTACCAAAAACGACTCTTACCGTTTCAACGCGCAGATC<br>AACAACTTCCTGGCGAACAACAAAGACATCAACATCATCGGTGTTGACCGTGGTGAAAAACACCTGGTT<br>TACTACTCTGTTATCACCCAGGCGTCTGACATCCTGGAATCTGGTTCTCTGTGAACGAACTGAACGGTGTTA<br>ACTACGCGGAAAAACTGGGTAAAAAAGCGGAAAACCGTGAACAGGCGCGTCGTGACTGGCAGGACGTT<br>CAGGGTATCAAAGACCTGAAAAAAGGTTACATCTCTCAGGTTGTTCGTAAACTGGCGGACCTGGCGATC<br>AAACACAACGCGATCATCATCCTGGAAGACCTGAACATGCGTTTCAAACAGGTTCGTGGTGGTATCGAA<br>AAATCTATCTACCAGCAGCTGGAAAAAGCGCTGATCGACAAACTGTCTTTCCTGGTTGACAAAGGTGAA<br>AAAAACCCGGACAGGCGGGTCACCTGCTGAAAGCGTACCAGCTGTCTGCGCCGTTCGAAACCTTCCAG<br>AAAATGGGTAAACAGACCGGTATCATCTTCTACACCCAGGCGTCTTACACCTCTAAATCTGACCCGGTTA<br>CCGGTTGGCGTCCGCACCTGTACCTGAAATACTTCTCTGCGAAAAAAGCGAAAGACGACATCGCGAAAT<br>TCACCAAAATCGAATTCGTTAACGACCGTTTCGAACTGACCTACGACATCAAAGACTTCCAGCAGGCGA<br>AGAATACCCGAACAAAACCGTTTGGAAAGTTTGCTCTAACGTTTGAACGTTTCCGTTGGGACAAAAACC<br>TGAACCAGAACAAAGGTGGTTACACCCACTACACCAACATCACCGAAAACATCCAGGAACTGTTCACCA<br>AATACGGTATCGACATCACCAAAGACCTGCTGACCCAGATCTCTACCATCGACGAAAACAGAACACCT<br>CTTTCTTCCGTGACTTCATCTTCTACTTCAACCTGATCTGCCAGATCCGTAACACCGACGACTCTGAAATC<br>GCGAAAAAAACGGTAAAGACGACTTCATCCTGTCTCCGGTTGAACGTTCTTCGACTCTCGTAAAAAC<br>AACGGTAAACAACTGCCGGAAAACGGTGACGACAACGGTGCGTACAACATCGCGCGTAAAGGTATCGT<br>TATCCTGAACAAATCTCTCAGTACTCTGAAAAAAACGAAAACTGCGAAAAATGAAATGGGGTGACCT<br>GTACGTTTCTAACATCGACTGGGACAACTTCGTTGAAATCATCCTTAGCGAAAGCTAAGGATTTTTTTA<br>TCTGAAATGTAGGGAGACCCTCAGGTTAAATATTCACTCAGGAAGTTATTACTCAGGAAGCAAAGAGGA<br>TTACA |
| SEQ ID NO: | AATCAGGAGAGCGTTTTCAATCCTACCTCTGGCGCAGTTGATATGTCAAACAGGTTGCCGTCACTGCGTC<br>TTTTACTGGCTCTTCTCGCTAACCAAACCGGTAACCCCGCTTATTAAAAGCATTCTGTAACAAAGCGGGA<br>CCAAAGCCATGACAAAAACGCGTAACAAAAGTGTCTATAATCACGGCAGAAAAGTCCACATTGATTATT |

TABLE 5-continued

| SEQ ID NO | Sequence |
|---|---|
| 71 | TGCACGGCGTCACACTTTGCTATGCCATAGCATTTTTATCCATAAGATTAGCGGATCCTACCTGACGCTT<br>TTTATCGCAACTCTCTACTGTTTCTCCATACCCGTTTTTTTGGGCTAGCAGTAATACGACTCACTATAGGG<br>GTCTCATCTCGTGTGAGATAGGCGGAGATACGAACTTTAAGAGGAGGATATACCATGCACCATCATCAT<br>CACCATAACAAATTCGAAAACTTCACCGGTCTGTACCCGATCTCTAAAACCCTGCGTTTCGAACTGATCC<br>CGCAGGGTAAAACCCTGGAATACATCGAAAAATCTGAAATCCTGGAAAACGACAACTACCGTGCGGAA<br>AAATACGAAGAAGTTAAAGACATCATCGACGGTTACCACAAATGGTTCATCAACGAAACCCTGCACGAC<br>CTGCACATCAACTGGTCTGAACTGAAAGTTGCGCTGGAAAACAACCGTATCGAAAAATCTGACGCGTCT<br>AAAAAAGAACTGCAGCGTGTTCAGAAAATCAAACGTGAAGAAATCTACAACGCGTTCATCGAACACGA<br>AGCGTTCCAGTACCTGTTCAAAGAAAACCTGCTGTCTGACCTGCTGCCGATCCAGATCGAACAGTCTGA<br>AGACCTGGACGCGGAAAAAAAAAACAGGCGGTTGAAACCTTCAACCGTTTCTCTACCTACTTCACCGG<br>TTTCCACGAAAACCGTAAAAACATCTACTCTAAAGAAGGTATCTCTACCTCTGTTACCTACCGTATCGTT<br>CACGACAACTTCCCGAAATTCCTGGAAAACATGAAAGTTTTCGAAATCCTGCGTAACGAATGCCCGGAA<br>GTTATCTCTGACACCGCGAACGAACTGGCGCCGTTCATCGACGGTGTTCGTATCGAAGACATCTTCCTGA<br>TCGACTTCTTCAACTCTACCTTCTCTCAGAACGGTATCGACTACTACAACCGTATCCTGGGTGGTGTTACC<br>ACCGAAACCGGTGAAAATACCGTGGTATCAACGAATTCACCAACCTGTACCGTCAGCAGCACCCGGAA<br>TTCGGTAAATCTAAAAAAGCGACCAAAATGGTTGTTCTGTTCAAACAGATCCTGTCTGACCGTGACACCC<br>TGTCTTTCATCCCGGAAATTGTTCGGTAACGACAAACAGGTTCAGAACTCTATCCAGCTGTTCTACAACCG<br>TGAAATCTCTCAGTTCGAAAACGAAGGTGTTAAAACCGACGTTTGCACCGCGCTGGCGACCCTGACCTC<br>TAAAATCGCGGAATTCGACACCGAAAAATCTACATCCAGCAGCCGGAACTGCCGAACGTTTCTCAGCG<br>TCTGTTCGGTTCTTGGAACGAACTGAACGCGTGCCTGTTCAAATACGCGGAACTGAAATTCGGTACCGCG<br>GAAAAAGTTGCGAACCGTAAAAAAATCGACAAATGGCTGAAATCTGACCTGTTCTCTTTCACCGAACTG<br>AACAAAGCGCTGGAATTCTCTGGTAAAGACGAACGTATCGAAAACTACTTCTCTGAAACCGGTATCTTC<br>GCGCAGCTGGTTAAAACCGGTTTCGACGAAGCGCAGTCTATCCTGGAAACCGAATACACCTCTGAAGTT<br>CACCTGAAAGACCAGCAGACCGACATCGAAAAAATCAAAACCTTCCTGGACGCGCTGCAGAACCTGAT<br>GCACCTGCTGAAATCTCTGTGCGTTTCTGAAGAAGCGGACCGTGACGCGGCGTTCTACAACGAATTCGA<br>CATGCTGTACAACCAGCTGAAACTGGTTGTTCCGCTGTACAACAAAGTTCGTAACTACATCACCCAGAA<br>ACTGTTCCGTTCTGACAAAATCAAAATCTACTTCGAAAACAAAGGTCAGTTCCTGGGTGGTTGGGTTGAC<br>TCTCAGACCGAAAACTCTGACAACGGTACCCAGGCGGGTGGTTACATCTTCCGTAAAGAAAACGTTATC<br>AACGAATACGACTACTACCTGGGTATCTGCTCTGACCCGAAACTGTTCCGTCGTACCACCATCGTTTCTG<br>AAAACGACCGTTCTTCTTTCGAACGTCTGGACTACTACCAGCTGAAAACCGCGTCTGTTTACGGTAACTC<br>TTACTGCGGTAAACACCCGTACACCGAAGACAAAAACGAACTGGTTAACTCTATCGACCGTTTCGTTCA<br>CCTGTCTGGTAACAACATCCTGATCGAAAAAATCGCGAAAGACAAAGTTAAATCTAACCCGACCACCAA<br>CACCCCGTCTGGTTACCTGAACTTCATCCACCGTGAAGCGCCAACACCTACGAATGCCTGCTGCAGGA<br>CGAAAACTTCGTTTCTCTGAACCAGCGTGTTGTTTCTGCGCTGAAACGCGACCCTGGCGACCCTGGTTCGT<br>GTTCCGAAAGCGCTGGTTTACGCGAAAAAAGACTACCACCTGTTCTCTGAAATCATCAACGACATCGAC<br>GAACTGTCTTACGAAAAGCGTTCTCTTACTTCCCGGTTTCTCAGACCGAATTCGAAAACTCTTCTAACC<br>GTACCATCAAACCGCTGCTGCTGTTCAAAATCTCTAACAAAGACCTGTCTTTCGCGGAAAACTTCGAAAA<br>AGGTAACCGTCAGAAAATCGGTAAAAAAACCTGCACACCTGACTACTTCGAAGCGCTGATGAAAGGTA<br>ACCAGGACACCATCGACATCGGTACCGGTATGGTTTTCCACCGTGTTAAATCTCTGAACTACAACGAAA<br>AAACCCTGAAATACGGTCACCACTCTACCCAGCTGAACGAAAAATTCTCTTACCCGATCATCAAAGACA<br>AACGTTTCGCGTCTGACAAATTCCTGTTCCACCTGTCTACCGAAATCAACTACAAAGAAAAACGTAAAC<br>CGCTGAACAACTCTATCATCGAATTCCTGACCAACAACCCGGACATCAACATCAACATCGGTCTGGACGTG<br>GTGAACGTCACCTGATCTACCTGACCCTGATCAACCAGAAAGGTGAAATCCTGCGTCAGAAACCTTCA<br>ACATCGTTGGTAACACCAACTACCACGAAAACTGAACCAGCGTGAAAAGAACGTGACAACGCGCGT<br>AAATCTTGGGCGACCATCGGTAAAATCAAAGAACTGAAAGAAGGTTTCCTGTCTCTGGTTATCCACGAA<br>ATCGCGAAATCATGGTTGAAAACAACGCGATCGTTGTTCGGAACCTGAACTTCGGTTTCAAACGT<br>GGTCGTTTCAAAGTTGAAAAACAGATCTACCAGAAATTCGAAAAAATGCTGATCGACAAACTGAACTAC<br>CTGGTTTTCAAAGACAAAAAGCGAACGAAGCGGGTGGTGTTCTGAAAGGTTACCAGCTGGCGGAAAA<br>ATTCGAATCTTTCCAGAAAATGGGTAAACAGTCTGGTTTCCTGTTCTACGTTCCGGCGGCGTACACCTCT<br>AAAATCGACCCGACCACCGGTTTCGTTAACATGCTGAACCTGAACTACACCAACATGAAAGACGCGCAG<br>ACCCTGCTGTCTGGTATGGACAAAATCTCTTTCAACGCGGACGCGAACTACTTCGAATTCGAACTGGACT<br>ACGAAAAATTCAAAACCAACCAGACCGACCACACCAACAAATGGACCATCGCACCGTTGGTGAAAAA<br>CGTTTCACCTACAACTCTGCGACCAAAGAAACCACCACCGTTAACGTTACCGAAGACCTGAAAAAACTG<br>CTGGACAAATTCGAAGTTAAATACTCTAACGGTGACAACATCAAAGACGAAATCTGCCGTCAGACCGAC<br>GCGAAATTCTTCGAAATCATCCTGTGGCTGCTGAAACTGACCATGCAGATGCGTAACTCTAACACCAAA<br>ACCGAAGAAGACTTCATCCTGTCTCCGGTTAAAAACTCTAACGGTGAATTCTTCCGTTCTAACGACGACG<br>CGAACGGTATCTGGCCGGCGGACGCGGACGCGAACGGTGCGTACCACATCGCGCTGAAAGGTCTGTACC<br>TGGTTAAAGAATGCTTCAACAAAAACGAAAATCTCTGAAAATCGAACACAAAACTGGTTCAAATTCG<br>CGCAGACCCGTTTCAACGGTTCTCTGACCAAAAACGGTTAAGAAATCATCCTTAGCGAAAGCTAAGGAT<br>TTTTTTTATCTGAAATGTAGGGAGACCCTCAGGTTAAATATTCACTCAGGAAGTTATTACTCAGGAAGCA<br>AAGAGGATTACA |
| 72 | AATCAGGAGAGCGTTTTCAATCCTACCTCTGGCGCAGTTGATATGTCAAACAGGTTGCCGTCACTGCGTC<br>TTTTACTGGCTCTTTCGCTAACCAAACCGGTAACCCCGCTTATTAAAAGCATTCTGTAACAAAGCGGGA<br>CCAAAGCCATGACAAAAACGCGTAACAAAAGTGTCTATAATCACGGCAGAAAGTCCACATTGATTATT<br>TGCACGGCGTCACACTTTGCTATGCCATAGCATTTTTATCCATAAGATTAGCGGATCCTACCTGACGCTT<br>TTTATCGCAACTCTCTACTGTTTCTCCATACCCGTTTTTTTGGGCTAGCAGTAATACGACTCACTATAGGG<br>GTCTCATCTCGTGTGAGATAGGCGGAGATACGAACTTTAAGAGGAGGATATACCATGCACCATCATCAT<br>CACCATACCCAGTTCGAAGGTTTCACCAACCTGTACCAGGTTTCTAAAACCCTGCGTTTCGAACTGATCC<br>CGCAGGGTAAAACCCTGAAACACATCCAGGAACAGGGTTTCATCGAAGAAGACAAAGCGCGTAACGAC<br>CACTACAAAGAACTGAAAACCGATCATCGACCGTATCTACAAAACCGACCAGTGCCTGCAGCTG<br>GTTCAGCTGGACTGGGAAAACCTGTCTGCGGCGATCGACTCTTACCGTAAAGAAAAACCGAAGAAACC<br>CGTAACGCGCTGATCGAAGAACAGGCGACCTACCGTAACGCGATCCACGACTACTTCATCGGTCGTACC<br>GACAACCTGACCGACGCGATCAACAAACGTCACGCGGAAATCTACAAAGGTCTGTTCAAAGCGGAACT<br>GTTCAACGGTAAAGTTCTGAAACAGCTGGGTACCGTTACCACCACCGAACACGAAAACGCGCTGCTGCG<br>TTCTTTCGACAAATTCACCACCTACTTCTCTGGTTTCTACGAAAACCGTAAAAACGTTTTCTCTGCGGAA |

TABLE 5-continued

| SEQ ID NO | Sequence |
|---|---|
| | GACATCTCTACCGCGATCCCGCACCGTATCGTTCAGGACAACTTCCCGAAATTCAAAGAAAACTGCCAC<br>ATCTTCACCCGTCTGATCACCGCGGTTCCGTCTCTGCGTGAACACTTCGAAAACGTTAAAAAAGCGATCG<br>GTATCTTCGTTTCTACCTCTATCGAAGAAGTTTTCTCTTTCCCGTTCTACAACCAGCTGCTGACCCAGACC<br>CAGATCGACCTGTACAACCAGCTGCTGGGTGGTATCTCTCGTGAAGCGGGTACCGAAAAAATCAAAGGT<br>CTGAACGAAGTTCTGAACCTGGCGATCCAGAAAAACGACGAAACCGCGCACATCATCGCGTCTCTGCCG<br>CACCGTTTCATCCCGCTGTTCAAACAGATCCTGTCTGACCGTAACACCCGTCTTTCATCCTGGAAGAAT<br>TCAAATCTGACGAAGAAGTTATCCAGTCTTTCTGCAAATACAAAACCCTGCTGCGTAACGAAAACGTTCT<br>GGAAACCGCGGAAGCGCTGTTCAACGAACTGAACTCTATCGACCTGACCCACATCTTCATCTCTCACAA<br>AAAACTGGAAACCATCTCTTCTGCGCTGTGCGACCACTGGGACACCCTGCGTAACGCGCTGTACGAACG<br>TCGTATCTCTGAACTGACCGGTAAAATCACCCAAATCTGCGAAAGAAAAAGTTCAGCGTTCTCTGAAACA<br>CGAAGACATCAACCTGCAGGAAATCATCTCTGCGGCGGGTAAAGAACTGTCTGAAGCGTTCAAACAGAA<br>AACCTCTGAAATCCTGTCTCACGCGCACGCGGCGCTGGACCAGCCGCTGCCGACCACCCTGAAAAAACA<br>GGAAGAAAAAGAAATCCTGAAATCTCAGCTGGACTCTCTGCTGGGTCTGTACCACCTGCTGGACTGGTT<br>CGCGGTTGACGAATCTAACGAAGTTGACCCGGAATTCTCTGCGCGTCTGACCGGTATCAAACTGGAAAT<br>GGAACCGTCTCTGTCTTTCTACAACAAAGCGCGTAACTACGCGACCAAAAACCGTACTCTGTTGAAAA<br>ATTCAAACTGAACTTCCAGATGCCGACCCTGGCGTCTGGTTGGGACGTTAACAAAGAAAAAAACAACGG<br>TGCGATCCTGTTCGTTAAAAACGGTCTGTACTACCTGGGTATCATGCCGAAACAGAAAGGTCGTTACAA<br>AGCGCTGTCTTTCGAACCGACCGAAAAAACCTCTGAAGGTTTCGACAAAATGTACTACGACTACTTCCC<br>GGACGCGGCGAAAATGATCCCGAAATGCTCTACCCAGCTGAAAGCGGTTACCGCGCACTTCCAGACCCA<br>CACCACCCCGATCCTGCTGTCTAACAACTTCATCGAACCGCTGGAAATCACCAAAGAAATCTACGACCT<br>GAACAACCCGGAAAAAGAACCGAAAAGAATTCCAGACGCGTACGCGAAAAAAACCGGTGACCAGAAA<br>GGTTACCGTGAAGCGCTGTGCAAATGGATCGACTTCACCCGTGACTTCCTGTCTAAATACACCAAAACC<br>ACCTCTATCGACCTGTCTTCTCTGCGTCCGTCTTCTCAGTACAAAGACCTGGGTGAATACTACGCGGAAC<br>TGAACCCGCTGCTGTACCACATCTCTTTCCAGCGTATCGCGGAAAAAGAAATCATGGACGCGGTTGAAA<br>CCGGTAAAGTGTACCTGTTCCAGATCTACAACAAAGACTTCGCGAAAGGTCACCACGGTAAACCGAACC<br>TGCACACCCTGTACTGGACCGGTCTGTTCTCTCCGGAAAACCTGGCGAAAACCTCTATCAAACTGAACG<br>GTCAGGCGGAACTGTTCTACCGTCCGAAATCTCGTATGAAACGTATGGCGCACCGTCTGGGTGAAAAAA<br>TGCTGAACAAAAAACTGAAAGACCAGAAAACCCCGATCCCGGACACCCTGTACCAGGAACTGTACGAC<br>TACGTTAACCACCGTCTGTCTCACGACCTGTCTGACGAAGCGCGTGCGCTGCTGCCGAACGTTATCACCA<br>AAGAAGTTTCTCACGAAATCATCAAAGACCGTCGTTTCACCTCTGACAAATTCTTCTTCCACGTTCCGAT<br>CACCCTGAACTACCAGGCGGCGAACTCTCCGTCTAAATTCAACCAGCGTGTTAACGCGTACCTGAAAGA<br>ACACCCGGAAACCCCGATCATCGGTATCGACCGTGGTAACGTAACCTGATCTACATCACCGTTATCGA<br>CTCTACCGGTAAAATCCTGGAACAGCGTTCTCTGAACACCATCCAGCAGTTCGACTACCAGAAAAACT<br>GGACAACCGTGAAAAAGAACGTGTTGCGGCGCGTCAGGCGTCTGTTGTTGGTACCATCAAAGACCT<br>GAAACAGGGTTACCTGTCTCAGGTTATCCACGAAATCGTTGACCTGATGATCCACTACCAGGCGGTTGTT<br>GTTCTGGAAAACCTGAACTTCGGTTTCAAATCTAAACGTACCGGTATCGCGGAAAAAGCGGTTTACCAG<br>CAGTTCGAAAAAATGCTGATCGACAAACTGAACTGCCTGGTTCTGAAAGACTACCCGGCGGAAAAAGTT<br>GGTGGTGTTCTGAACCCGTACCAGCTGACCGACCAGTTCACCTCTTTCGCGAAAATGGGTACCCAGTCTG<br>GTTTCCTGTTCTACGTTCCGGCGCCGTACACCTCTAAAATCGACCCGCTGACCGGTTTCGTTGACCCGTTC<br>GTTTGGAAAACCATCAAAAACCACGAATCTGTAAACACTTCCTGGAAGGTTTCGACTTCCTGCACTACG<br>ACGTTAAACCGGTGACTTCATCCTGCACTTCAAAATGAACCGTAACCTGTCTTTCCAGCGTGGTCTGCC<br>GGGTTTCATGCCGGCGTGGGACATCGTTTTCGAAAAAAACCAGTTCGACGCGAAAGGTACCCC<br>GTTCATCGCGGGTAAACGTATCGTTCCGGTTATCGAAAACCACCGTTTCACCGGTCGTTACCGTGACCTG<br>TACCCGGCGAACGAACTGATCGCGCTGCTGGAAGAAAAAGGTATCGTTTTCCGTGACGTTCTAACATC<br>CTGCCGAAACTGCTGGAAAACGACGACTCTCACGCGATCGACACCATGGTTGCGCTGATCCGTTCTGTTC<br>TGCAGATGCGTAACTCTAACGCGGCGACCGGTGAAGACTACACAACTCTCCGGTTCGTGACCTGAACG<br>GTGTTTGCTTCGACTCTCGTTTCCAGAACCCGGAATGGCCGATGGACGCGGACGCGAACGGTGCGTACC<br>ACATCGCGCTGAAAGGTCAGCTGCTGCTGAACCACCTGAAGAATCTAAAGACCTGAAACTGCAGAACG<br>GTATCTCTAACCAGGACTGGCTGGCGTACATCCAGGAACTGCGTAACTAGAAATCATCCTTAGCGAAAG<br>CTAAGGATTTTTTTTATCTGAAATGTAGGGAGACCCTCAGGTTAAATATTCACTCAGGAAGTTATTACTC<br>AGGAAGCAAAGAGGATTACA |
| SEQ ID NO: 73 | AATCAGGAGAGCGTTTTCAATCCTACCTCTGGCGCAGTTGATATGTCAAACAGGTTGCCGTCACTGCGTC<br>TTTTACTGGCTCTTCTCGCTAACCAAACCGGTAACCCCGCTTATTAAAAGCATTCTGTAACAAAGCGGGA<br>CCAAAGCCATGACAAAAACGCGTAACAAAAGTGTCTATAATCACGGCAGAAAAGTCCACATTGATTATT<br>TGCACGGCGTCACACTTTGCTATGCCATAGCATTTTTATCCATAAGATTAGCGGATCCTACCTGACGCTT<br>TTTATCGCAACTCTCTACTGTTTCTCCATACCCGTTTTTTGGGCTAGCAGTAATACGACTCACTATAGGG<br>GTCTCATCTCGTGTGAGATAGGCGGAGATACGAACTTTAAGGAGGAGATATACCATGCACCATCATCAT<br>CACCATGCGGTTAAATCTATCAAAGTTAAACTGCGTCTGGACGACATGCCGGAAATCCGTCAGGTCTG<br>TGGAAACTGCACAAAGAAGTTAACGCGGGTGTTCGTTACTACACCGAATGGCTGTCTCTGCTGCGTCAG<br>GAAAAACCTGTACCGTCGTTCTCCGAACGGTGACGGTGAACAGGAATGCGACAAAACCGCGGAAGAATG<br>CAAAGCGGAACTGCTGGAACGTCTGCGTGCGCGTCAGGTTGAAAACGGTCACCGTGGTCCGGCGGGTTC<br>TGACGACGAACTGCTGCAGCTGGCGCGTCAGCTGTACGAACTGCTGGTTCCGCAGGCGATCGGTGAAA<br>AGGTGACGCGCAGCAGATCGCGCGTAAATTCCTGTCTCCGCTGGCGGACAAAGACGCGGTTGGTGGTCT<br>GGGTATCGCGAAAGCGGGTAACAAACCGCGTTGGGTTCGTATGCGTGAAGCGGGTGAACGGGTTGGG<br>AAGAAGAAAAAGAAAAGCGGAAACCCGTAAATCTGCGGACCGTACCGCGGACGTTCTGCGTGCGCTG<br>GCGGACTTCGGTCTGAAACCTGATGCGTGTTTACACCGTCTGGAAGTCTTCTGTTGAATGGAAAC<br>CGCTGCGTAAAGGTCAGGCGGTTCGTACCTGGGACCGTGACATGTTCCAGCAGGCGATCGAACGTATGA<br>TGTCTTGGGAATCTTGGAACCAGCGTGTTGGTCAGGAATACGCGAAACTGGTTGAACAGAAAACCGTT<br>TCGAACAGAAAACTTCGTTGGTCAGGACACCTGGTTCACCTGGTTAACCAGCTGCAGCAGGACATGA<br>AAGAAGCGTCTCCGGGTCTGGAATCTAAAGAACAGACCGCACTACGTTACCGGTCTGCGTCGTG<br>GTTCTGACAAAGTTTTCGAAAAATGGGGTAAACTGGCGCCGGACGCGCCGTTCGACCTGTACGACGCGG<br>AAATCAAAAACGTTCAGCGTCGTAACACCCGTCGTTTCGGTTCTCACGACCTGTTCGCGAAACTGGCGG<br>AACCGGAATACCAGGCGCTGTGGCGTGAAGACGCGTCTTTCCTGACCCGTTACGCGGTTTACAACTCTAT<br>CCTGCGTAAACTGAACCACGCGAAAATGTTCGCGACCTTCACCCTGCCGGACGCGACCGCGCACCCGAT<br>CTGGACCCGTTTCGACAAACTGGGTGGTAACCTGCACCAGTACACCTTCCTGTTCAACGAATTCGGTGAA |

TABLE 5-continued

| SEQ ID NO | Sequence |
|---|---|
| | CGTCGTCACGCGATCCGTTTCCACAAACTGCTGAAAGTTGAAAACGGTGTTGCGCGTGAAGTTGACGAC<br>GTTACCGTTCCGATCTCTATGTCTGAACAGCTGGACAACCTGCTGCCGCGTGACCCGAACGAACCGATCG<br>CGCTGTACTTCCGTGACTACGGTGCGGAACAGCACTTCACCGGTGAATTCGGTGGTGCGAAAATCCAGT<br>GCCGTCGTGACCAGCTGGCGCACATGCACCGTCGTCGTGGTGCGCGTGACGTTTACCTGAACGTTTCTGT<br>TCGTGTTCAGTCTCAGTCTGAAGCGCGTGGTGAACGTCGTCCGCCGTACGCGGCGGTTTTCCGTCTGGTT<br>GGTGACAACCACCGTGCGTTCGTTCACTTCGACAAACTGTCTGACTACCTGGCGGAACACCCGGACGAC<br>GGTAAACTGGGTTCTGAAGGTCTGCTGTCTGGTCTGCGTGTTATGTCTGTTGACCTGGGTCTGCGTACCT<br>CTGCGTCTATCTCTGTTTTCCGTGTTGCGCGTAAAGACGAACTGAAACCGAACTCTAAAGGTCGTGTTCC<br>GTTCTTCTTCCCGATCAAAGGTAACGACAACCTGGTTGCGGTTCACGAACGTTCTCAGCTGCTGAAACTG<br>CCGGGTGAAACCGAATCTAAAGACCTGCGTGCGATCCGTGAAGAACGTCAGCGTACCCTGCGTCAGCTG<br>CGTACCCAGCTGGCGTACCTGCGTCTGCTGGTTCGTTCGGTTCTGAAGACGTTGGTCGTCGTGAACGTT<br>CTTGGGCGAAACTGATCGAACAGCCGGTTGACGCGGCGAACCACATGACCCCGGACTGGCGTGAAGCGT<br>TCGAAAACGAACTGCAGAAACTGAAATCTCTGCACGGTATCTGCTCTGACAAAGAATGGATGGACGCGG<br>TTTACGAATCTGTTCGTCGTGTTTGGCGTCACATGGGTAAACAGGTTCGTGACTGGCGTAAAGACGTTCG<br>TTCTGGTGAACGTCCGAAAATCCGTGGTTACGCGAAAGACGTTGTTGGTGGTAACTCTATCGAACAGAT<br>CGAATACCTGGAACGTCAGTACAAATTCCTGAAATCTTGGTCTTTCTTCGGTAAAGTTTCTGGTCAGGTT<br>ATCCGTGCGGAAAAGGTTCTCGTTTCGCGATCACCCTGCGTGAACACATCGACCACGCGAAAGAAGAC<br>CGTCTGAAAAACTGGCGGACCGTATCATCATGGAAGCGCTGGGTTACGTTTACGCGCTGGACGAACGT<br>GGTAAAGGTAAATGGGTTGCGAAATACCCGCCGTGCCAGCTGATCCTGCTGGAAGAACTGTCTGAATAC<br>CAGTTCAACAACGACCGTCCGCCGTCTGAAAACAACCAGCTGATGCAGTGGTCTCACCGTGGTGTTTTCC<br>AGGAACTGATCAACCAGGCGCAGGTTCACGACCTGCTGGTTGGTACCATGTACGCGGCGTTCTCTTCTCG<br>TTTCGACGCGCGTACCGGTGCGCGGGGTATCCGTTGCCGTCGTGTTCCGGCGCGTTGCACCCAGGAACAC<br>AACCCCGGAACCGTTCCCGTGGTGGCTGAACAAATTCGTTGTTGAACACACCCTGGACGCGTGCCCGCTG<br>CGTGCGGACGACCTGATCCCGACCGGTGAAGGTGAAATCTTCGTTTCTCCGTTCTCTGCGGAAGAAGGT<br>GACTTCCACCAGATCCACGCGGACCTGAACGCGGCGCAGAACCTGCAGCAGCGTCTGTGGTCTGACTTC<br>GACATCTCTCAGATCCGTCTGCGTTGCGACTGGGGTGAAGTTGACGGTGAACTGGTTCTGATCCCGCGTC<br>TGACCGGTAAACGTACCGCGGACTCTTACTCTAACAAAGTTTTCTACACCAACACCGGTGTTACCTACTA<br>CGAACGTGAACGTGGTAAAAAACGTCGTAAAGTTTTCGCGCAGGAAAAACTGTCTGAAGAAGAAGCGG<br>AACTGCTGGTTGAAGCGGACGAAGCGCGTGAAAAATCTGTTGTTCTGTGATGCGTGACCCGTCTGGTATCA<br>TCAACCGTGGTAACTGGACCCGTCAGAAAGAATTCTGGTCTATGGTTAACCAGCGTATCGAAGGTTACC<br>TGGTTAAACAGATCCGTTCTCGTGTTCCGCTGCAGGACTCTGCGTGCGAAAACACCGGTGACATCTAAG<br>AAATCATCCTTAGCGAAAGCTAAGGATTTTTTTTATCTGAAATGTAGGGAGACCCTCAGGTTAAATATTC<br>ACTCAGGAAGTTATTACTCAGGAAGCAAAGAGGATTACA |
| SEQ ID NO: 74 | AATCAGGAGAGCGTTTTCAATCCTACCTCTGGCGCAGTTGATATGTCAAACAGGTTGCCGTCACTGCGTC<br>TTTTACTGGCTCTTCTCGCTAACCAAACCGGTAACCCCGCTTATTAAAAGCATTCTGTAACAAAGCGGGA<br>CCAAAGCCATGACAAAAACGCGTAACAAAAGTGTCTATAATCACGGCAGAAAAGTCCACATTGATTATT<br>TGCACGGCGTCACACTTTGCTATGCCATAGCATTTTTTATCCATAAGATTAGCGAACATCCTACCTGACGCTT<br>TTTATCGCAACTCTCTACTGTTTCTCCATACCCGTTTTTTTGGGCTAGCAGTAATACGACTCACTATAGGG<br>GTCTCATCTCGTGTGAGATAGGCGGAGATACGAACTTTAAGAGGAGGATATACCATGCACCATCATCAT<br>CACCATGCGACCCGTTCTTTCATCCTGAAATCGAACCGAACGAAGAAGTTAAAAAGGTCGTGTGGAAA<br>ACCCACGAAGTTCTGAACCACGGTATCGCGTACTACATGAACATCCTGAAACTGATCCGTCAGGAAGCG<br>ATCTACGAACACCACGAACAGGACCCGAAAAACCCGAAAAAAGTTTCTAAAGCGGAAATCCAGGCGGA<br>ACTGTGGGACTTCGTTCTGAAAATGCAGAAATGCAACTCTTTCACCCACGAAGTTGACAAAGACGTTGTT<br>TTCAACATCCTGCGTGAACTGTACGAAGAACTGGTTCCGTCTTCTGTTGAAAAAAAGGTGAAGCGAAC<br>CAGCTGCTAACAAATTCCTGTACCCGCTGGTTGACCGAACTCTCAGTCTGGTAAAGGTACCGCGTCTT<br>CTGGTCGTAAACCGCGTTGGTACAACCTGAAATCGCGGGTGACCCGTCTTGGGAAGAAGAAAAAAAAA<br>AAATGGGAAGAAGACAAAAAAAAGACCCGCTGGCGAAAATCCTGGGTAAACTGCGGAATACGGTCT<br>GATCCCGCTGTTCATCCCGTTCACCGACTCTAACGAACCGATCGTTAAAGAAATCAAATGGATGGAAAA<br>ATCTCGTAACCAGTCTGTTCGTCGTCTGGACAAAGACATGTTCATCCAGGCGCTGGAACCGTTTCCTGTCT<br>TGGGAATCTTGGAACCTGAAAGTTAAAGAAGAATACGAAAAAGTTGAAAAAGAACACAAAACCCTGGA<br>AGAACGTATCAAAGAAGACATCCAGGCGTTCAAATCTCTGGAACAGTACGAAAAAGAACGTCAGGAAC<br>AGCTGCTGCGTGACACCCTGAACACCAACGAATACCGTCTGTCTAAACGTGGTCTGCGTGGTTGGCGTG<br>AAATCATCCAGAAATGGCTGAAAATGACGAAAACGAACCGTCTGAAAAATACCTGGAAGTTTTCAAA<br>GACTACCAGCGTAAACACCCGCGTGAAGCGGGTGACTACTCTGTTTACGAATTCCTGTCTAAAAAAGAA<br>AACCACTTCATCTGGCGTAACCACCCGGAATACCCGTACCTGTACGCGACCTTCTGCGAAATCGACAAA<br>AAAAAAAAAGACGCGAAACAGCAGGCGACCTTCACCCTGGCGGACCCGATCAACCACCGCTGTGGGT<br>TCGTTTCGAAGAACGTTCTGGTTCTAACCTGAACAAATACCGTATCCTGACCGAACAGCTGCACACCGA<br>AAAACTGAAAAAAAACTGACCGTTCAGCTGGACCGTCTGATCTACCCGACCGAATCTGGTGGTTGGGA<br>AGAAAAAGGTAAAGTTGACATCGTTCTGCTGCCGTCTCGTCAGTTCTACAACCAGATCTTCCTGGACATC<br>GAAGAAAAAGGTAAACACGCGTTCACCTACAAAGACGAATCTATCAAATTCCCGCTGAAAGGTACCCTG<br>GGTGGTGCGCGTGTTCAGTTCGACCGTGACCACCTGCGTCGTTACCCGCACAAAGTTGAATCTGGTAACG<br>TTGGTCGTATCTACTTCAACATGACCGTTAACATCGAACGCGACCGAAGTTCTCCGGTTTCTAAATCTCTGAA<br>AATCCACCGTGACGACTTCCCGAAATTCGTTAACTTCAAACCGAAAGAACTGACCGAATGGATCAAAGA<br>CTCTAAAGGTAAAAAACTGAAATCTGGTATCGAATCTCTGGAAATCGGTCTGCGTGTTATGTCTATCGAC<br>CTGGGTCAGCGTCAGGCGGCGGCGGCGTCTATCTTCGAAGTTGTTGACCAGAAACCGGACATCGAAGGT<br>AAACTGTTCTTCCCGATCAAAGGTACCGAACTGTACGCGGTTCACCGTGCCTTTCAACATCAAACTGC<br>CGGGTGAAACCCTGGTTAAATCTCGTGAAGTTCTGCGTAAAGCGCGTGAAGACAACCTGAAACTGATGA<br>ACCAGAAACTGAACTTCCTGCGTAACGTTCTGCACTTCCAGCAGTTCGAAGACATCACCGAACGTGAAA<br>AACGTGTTACCAAATGGATCTCTCGTCAGGAAAACTCTGACGTTCCGCTGGTTTACCAGGACGAACTGAT<br>CCAGATCCGTGAACTGATGTACAACAGTACAAAGACTGGGTTGCCTTCCTGAAACAGCTGCACAAACG<br>TCTGGAAGTTGAAATCGGTAAAGAAGTTAAACACTGGCGTAAATCTCTGTCTGACGGTCGTAAAGGTCT<br>GTACGGTATCTCTCTGAAAAACATCGACGAAATCGACCGTACCCGTAAATTCCTGCTGCGTTGGTCTCTG<br>CGTCCGACCGAACCGGGTGAAGTTCGTCGTCTGGAACCGGGTCAGCGTTTCGCGATCGACCAGCTGAAC<br>CACCTGAACGCGCTGAAAGAAGACCGTCTGAAAAAAATGGCGAACACCATCATCATGCACGCGCTGGG<br>TTACTGCTACGACGTTCGTAAAAAAAAATGGCAGGCGAAAAACCCGGCGTGCCAGATCATCCTGTTCGA |

TABLE 5-continued

| SEQ ID NO | Sequence |
|---|---|
| | AGACCTGTCTAACTACAACCCGTACGAAGAACGTTCTCGTTTCGAAAACTCTAAACTGATGAAATGGTCT<br>CGTCGTGAAATCCCGCGTCAGGTTGCGCTGCAGGGTGAAATCTACGGTCTGCAGGTTGGTGAAGTTGGT<br>GCGCAGTTCTCTTCTCGTTTCCACGCGAAAACCGGTTCTCCGGGTATCCGTTGCTCTGTTGTTACCAAAG<br>AAAAACTGCAGGACAACCGTTTCTTCAAAAACCTGCAGCGTGAAGGTCGTCTGACCCTGGACAAAATCG<br>CGGTTCTGAAAGAAGGTGACCTGTACCCGGACAAAGGTGGTGAAAAATTCATCTCTCTGTCTAAAGACC<br>GTAAACTGGTTACCACCCACGCGGACATCAACGCGGCGCAGAACCTGCAGAAACGTTTCTGGACCCGTA<br>CCCACGGTTTCTACAAAGTTTACTGCAAAGCGTACCAGGTTGACGGTCAGACCGTTTACATCCCGGAATC<br>TAAAGACCAGAAACAGAAATCATCGAAGAATTCGGTGAAGGTTACTTCATCCTGAAAGACGGTGTTTA<br>CGAATGGGGTAACGCGGGTAAACTGAAAATCAAAAAAGGTTCTTCTAAACAGTCTTCTTCTGAACTGGT<br>TGACTCTGACATCCTGAAAGACTCTTTCGACCTGGCGTCTGAACTGAAAGGTGAAAAACTGATGCTGTA<br>CCGTGACCCGTCTGGTAACGTTTTCCCGTCTGACAAATGGATGGCGGCGGGTGTTTTCTTCGGTAAACTG<br>GAACGTATCCTGATCTCTAAACTGACCAACCAGTACTCTATCTCTACCATCGAAGACGACTCTTCTAAAC<br>AGTCTATGTAAGAAATCATCCTTAGCGAAAGCTAAGGATTTTTTTTATCTGAAATGTAGGGAGACCCTCA<br>GGTTAAATATTCACTCAGGAAGTTATTACTCAGGAAGCAAAGAGGATTACA |
| SEQ ID NO: 75 | AATCAGGAGAGCGTTTTCAATCCTACCTCTGGCGCAGTTGATATGTCAAACAGGTTGCCGTCACTGCGTC<br>TTTTACTGGCTCTTCTCGCTAACCAAACCGGTAACCCCGCTTATTAAAAGCATTCTGTAACAAAGCGGGA<br>CCAAAGCCATGACAAAAACGCGTAACAAAAGTGTCTATAATCACGGCAGAAAAGTCCACATTGATTATT<br>TGCACGGCGTCACACTTTGCTATGCCATAGCATTTTATCCATAAGATTAGCGGATCCTACCTGACGCTT<br>TTTATCGCAACTCTCTACTGTTTCTCCATACCCGTTTTTTGGGCTAGCAGTAATACGACTCACTATAGGG<br>GTCTCATCTCGTGTGAGATAGGCGGAGATACGAACTTTAAGAGGAGGATATACCATGCACCATCATCAT<br>CACCATCCGACCCGTACCATCAACCTGAAACTGGTTCTGGGTAAAAACCCGGAAAACGCGACCCTGCGT<br>CGTGCGCTGTTCTCTACCCACCGTCTGGTTAACCAGGCGACCAAACGTATCGAAGAATTCCTGCTGCTGT<br>GCCGTGGTGAAGCGTACCGTACCGTTGACAACGAAGGTAAAGAAGCGGAAATCCCGCGTCACGCGGTTC<br>AGGAAGAAGCGCTGGCGTTCGCGAAAGCGGCGCAGCGTCACAACGGTTGCATCTCTACCTACGAAGACC<br>AGGAAATCCTGGACGTTCTGCGTCAGCTGTACGAACGTCTGGTTCCGTCTGTTAACGAAAACAACGAAG<br>CGGGTGACGCGCAGGCGGCGAACGCGTGGGTTTCTCCGCTGATGCTGCGGAATCTGAAGGTGGTCTGT<br>CTGTTTACGACAAAGTTCTGGACCCGCCGCCGGTTTGGATGAAACTGAAAGAAGAAAAAGCGCGGGTT<br>GGGAAGCGGCGTCTCAGATCTGGATCCAGTCTGACGAAGGTCAGTCTCTGCTGAACAAACCGGGTTCTC<br>CGCCGCGTTGGATCCGTAAACTGCGTTCTGGTCAGCCGTGGCAGGACGACTTCGTTTCTGACCAGAAAA<br>AAAAACAGGACGAACTGACCAAAGGTAACGCGCCGCTGATCAAACAGCTGAAAGAAATGGGTCTGCTG<br>CCGCTGGTTAACCCGTTCTTCCGTCACCTGCTGGACCCGGAAGGTAAAGGTGTTTCTCCGTGGGACCGTC<br>TGGCGGTTCGTGCGGCGGTTGCGCACTTCATCTCTTGGGAATCTTGGAACCACCGTACCCGTCGGAATA<br>CAACTCTCTGAAACTGCGTCGTGACGAATTCGAAGCGGCGTCTGACGAATTCAAAGACGACTTCAACCT<br>GCTGCGTCAGTACGAAGCGAAACGTCACTCTACCCTGAAATCTATCGCGCTGGCGGACGACTCTAACCC<br>GTACCGTATCGGTGTTCGTTCTCTGCGTGCGTGGAACCGTGTTCGTGAAGAATGGATCGACAAAGGTGC<br>GACCGAAGAACAGCGTGTTACCATCCTGTCTAAACTGCAGACCCAGCTGCGTGGTAAATTCGGTGACCC<br>GGACCTGTTCAACTGGCTGGCGCAGGACCGTCACGTTCACCTGTGGTCTCCGCGTGACTCTGTTACCCG<br>CTGGTTCGTATCAACGCGGTTGACAAAGTTCTGCGTCGTCGTAAACCGTACGCGCTGATGACCTTCGCGC<br>ACCCGCGTTTCCACCCGCGTTGGATCCTGTACGAAGCGCCGGGTGGTTCTAACCTGCGTCAGTACGCGCT<br>GGACTGCACCGAAAACGCGCTGCACATCACCCTGCCGCTGCTGGTTGACGACGCGCACGGTACCTGGAT<br>CGAAAAAAAAATCCGTGTTCCGCTGGCGCCGTCTGGTCAGATCCAGGACCTGACCCTGGAAAAACTGGA<br>AAAAAAAAAAACCGTCTGTACTACCGTTCTGGTTTCCAGCAGTTCGCGGGTCTGGCGGGTGGTGCGGA<br>AGTTCTGTTCCACCGTCCGTACATGGAACACGACGAACGTTCTGAAGAATCTCTGCTGGAACGTCCGGGT<br>GCGGTTTGGTTCAAACTGACCCTGGACGTTGCGACCCAGGCGCCGCCGAACTGGCTGGACGGTAAAGGT<br>CGTGTTCGTACCCCGCCGGAAGTTCACCACTTCAAAACGCGCTGTCTAACAAATCTAAACACACCCGTA<br>CCCTGCAGCCGGGTCTGCGTGTTCTGTCTGTTGACCTGGGTATGCGTACCTTCGCGTCTTGCTCTGTTTTC<br>GAACTGATCGAAGGTAAACCGGAAACCGGTCGTGCGTTCCCGGTTGCGGACGAACGTTCTATGGACTCT<br>CCGAACAAACTGTGGGCGAAACACGAACGTTCTTTCAAACTGACCCTGCCGGGTGAAACCCCGTCTCGT<br>AAAGAAGAAGAAGAAGTTCTATCGCGCGTTGCGAAATCTACGACGGTGAAACGTGACATCCAGCGTCTG<br>AAATCTCTGCTGCGTCTGGGTGAAGAAGACAACGACAACCGTCGTGACGCGCTGCTGGAACAGTTCTTC<br>AAAGGTTGGGGTGAAGAAGACGTTGTTCGGGTCAGGCGTTCCCGCGTTCTCTGTTCCAGGGTCTGGGT<br>GCGGCGCCGTTCCGTTCTACCCCGGAACTGTGGCGTCAGCACTGCCAGACCTACTACGACAAAGCGGAA<br>GCGTGCCTGGCGAAACACATCTCTGACTGGCGTAAACGTACCGCTCCGCGTCCGACCTCTGTCTGAAATGT<br>GGTACAAAACCCGTTCTTACCACGGTGGTAAATCTATCTGGATGCTGGAATACCTGGACGGGTTCGTA<br>AACTGCTGCTGTCTTGGTCTCTGCGTGGTCGTACCTACGGTGCGATCAACCGTCAGGACACCGCGCGTTT<br>CGGTTCTCTGGCGTCTCGTCTGCTGCACCACATCAACTCTCTGAAAGAAGACCGTATCAAAACCGGTGCG<br>GACTCTATCGTTCAGGCGGCGCGTGGTTACATCCCGCTGCCGCACGGTAAAGGTTGGGAACAGCGTTAC<br>GAACCGTGCCAGCTGATCCTGTTCGAAGACCTGGCGCGTTACCGTTTCCGTGTTGACCGTCCGCGTCGTG<br>AAAACTCTCAGCTGATGCAGTGGAACCACCGTGCGATCGTTGCGGAAACCACCATGCAGGCGGAACTGT<br>ACGGTCAGATCGTTGAAAACACCGCGGCGGGTTTCTCTTCTCGTTTCCACGCGGCGACCGGTGCGCCGG<br>GTGTTCGTTGCCGTTTCCTGCTGGAACGTGACTTCGACAACGACCTGCCGAAACCGTACCTGCTGCGTGA<br>ACTGTCTTGGATGCTGGGTAACACCAAAGTTGAATCTGAAGAAGAAAAACTGCGTCTGCTGCTGAAA<br>AATCCGTCCGGTTCTCTGGTTCCGTGGGACGGTGGTGAACAGTTCGCGACCCTGCACCCGAAACGTCA<br>GACCCTGTGCGTTATCCACGCGGACATGAACGCGGCGCAGAACCTGCAGCTGTTTCTTCGGTCGTTGC<br>GGTGAAGCGTTCCGTCTGGTTTGCCAGCCGCACGGTGACGACGTTCTGCGTCTGGCGTCTACCCCGGGTG<br>CGCGTCTGCTGGGTGCGCTGCAGCAGCTGGAAAACGGTCAGGGTGCGTTCGAACTGGTTCTGCGTCCTG<br>GTTCTACCTCTCAGATGAACCGTTTCGTTATGAAATCTCTGGGTAAAAAAAAATCAAACCGCTGCAGG<br>ACAACAACGGTGACGACGAACTGGAAGACGTTCGTCTGTTCTGCCGGAAGAAGACGACACCGGTCGTA<br>TCACCGTTTTCCGTGACTCTTCTGGTATCTTCTTCCCGTGCAACGTTTGGATCCCGGCGAAACAGTTCTGG<br>CCGGCGGTTCGTGCGATGATCTGGAAATGTATGGCGTCTCACTCTCGGGTTAAGAAATCATCCTTAGCG<br>AAAGCTAAGGATTTTTTTTATCTGAAATGTAGGGAGACCCTCAGGTTAAATATTCACTCAGGAAGTTATT<br>ACTCAGGAAGCAAAGAGGATTACA |
| SEQ ID | AATCAGGAGAGCGTTTTCAATCCTACCTCTGGCGCAGTTGATATGTCAAACAGGTTGCCGTCACTGCGTC<br>TTTTACTGGCTCTTCTCGCTAACCAAACCGGTAACCCCGCTTATTAAAAGCATTCTGTAACAAAGCGGGA |

TABLE 5-continued

| SEQ ID NO | Sequence |
|---|---|
| NO: 76 | CCAAAGCCATGACAAAAACGCGTAACAAAAGTGTCTATAATCACGGCAGAAAAGTCCACATTGATTATT<br>TGCACGGCGTCACACTTTGCTATGCCATAGCATTTTTATCCATAAGATTAGCGGATCCTACCTGACGCTT<br>TTTATCGCAACTCTCTACTGTTTCTCCATACCCGTTTTTTGGGCTAGCAGTAATACGACTCACTATAGGG<br>GTCTCATCTCGTGTGAGATAGGCGGAGATACGAACTTTAAGAGGAGGATATACCATGCACCATCATCAT<br>CACCATACCAAACTGCGTCACCGTCAGAAAAAACTGACCCACGACTGGGCGGGTTCTAAAAAACGTGAA<br>GTTCTGGGTTCTAACGGTAAACTGCAGAACCCGCTGCTGATGCCGGTTAAAAAAGGTCAGGTTACCGAA<br>TTCCGTAAAGCGTTCTCTGCGTACGCGCGTGCGACCAAAGGTGAAATGACCGACGGTCGTAAAAACATG<br>TTCACCCACTCTTTCGAACCGTTCAAAACCAAACCGTCTCTGCACCAGTGCGAACTGGCGGACAAAGCG<br>TACCCAGTCTCTGCACTCTTACCTGCCGGGTTCTCTGGCGCACTTCCTGCTGTCTGCGCACGCGCTGGGTTT<br>CCGTATCTTCTCTAAATCTGGTGAAGCGACCGCGTTCCAGGCGTCTTCTAAAATCGAAGCGTACGAATCT<br>AAACTGGCGTCTGAACTGGCGTGCGTTGACCTGTCTATCCAGAACCTGACCATCTCTACCCTGTTCAACG<br>CGCTGACCACCTCTGTTCGTGGTAAAGGTGAAGAAACCTCTGCGGACCCGCTGATCGCGCGTTTCTACAC<br>CCTGCTGACCGGTAAACCGCTGTCTCGTGACACCCAGGGTCCGGAACGTGACCTGGCGGAAGTTATCTC<br>TCGTAAAATCGCGTCTTCTTTCGGTACCTGGAAAGAAATGACCGCGAACCCGCTGCAGTCTCTGCAGTTC<br>TTCGAAGAAGAACTGCACGCGCTGGACGCGAACGTTTCTCTGTCTCCGGCGTTCGACGTTCTGATCAAAA<br>TGAACGACCTGCAGGGTGACCTGAAAAACCGTACCATCGTTTTCGACCCGGACGCGCCGGTTTTCGAAT<br>ACAACGCGGAAGACCCGGCGGACATCATCAAACTGACCGCGGTTACGCGAAAGAAGCGGTTATCTC<br>AAAAACCAGAACGTTGGTAACTACGTTAAAAACGCGATCACCACCACCAACGCGAACGGTCTGGGTTGG<br>CTGCTGAACAAAGGTCTGTCTCTGCTGCCGGTTTCTACCGACGACGAACTGCTGGAATTCATCGGTGTTG<br>AACGTTCTCACCCGTCTTGCCACGCGCTGATCGAACTGATCGCGCAGCTGGAAGCGCCGGAACTGTTCG<br>AAAAAAACGTTTTCTCTGACACCCGTTCTGAAGTTCAGGGTATGATCGACTCTGCGGTTTCTAACCACAT<br>CGCGCGTCTGTCTTCTTCTCGTAACTCTCTGTCTATGGACTCTGAAGAACTGGAACGTCTGATCAAATCTT<br>TCCAGATCCACACCCCGCACTGCTCTCTGTTCATCGGTGCGCAGTCTCTGTCTCAGCAGCTGGAATCTCT<br>GCCGGAAGCGCTGCAGTCTGGTGTTAACTCTGCGGACATCCTGCTGGGTTCTACCCAGTACATGCTGACC<br>AACTCTCTGGTTGAAGAATCTATCGCGACCTACCAGCGTACCCTCGAACCGTATCAACTACCTGTCTGGTG<br>TTGCGGGTCAGATCAACGGTGCGATCAAACGTAAAGCGATCGACGGTGAAAAAATCCACCTGCCGGCG<br>GCGTGGTCTGAACTGATCTCTCTGCCGTTCATCGGTCAGCCGGTTATCGACGTTGAATCTGACCTGGCGC<br>ACCTGAAAAACCAGTACCAGACCCTGTCTAACGAATTCGACACCCTGATCTCTGCGCTGCAGAAAAACT<br>TCGACCTGAACTTCAACAAAGCGTTGCTGAACCGTACCCAGCACTTCGAAGCGATGTGCCGTTCTACCA<br>AAAAAAACGCGCTGTCTAAACCGGAAATCGTTTCTTACCGTGACCTGCTGGCGCGTCTGACCTCTTGCCT<br>GTACCGTGGTTCTCTGGTTCTGCGTCGTGCGGGTATCGAAGTTCTGAAAAAACACAAAATCTTCGAATCT<br>AACTCTGAACTGCGTGAACACGTTCACGAACGTAAACACTTCGTTTTCGTTTCTCCGCTGGACCGTAAAG<br>CGAAAAAACTGCTGCGTCTGACCGACTCTCGTCCGGACCTGCTGCACGTTATCGACGAAATCCTGCAGC<br>ACGACAACCTGGAAAAACAAAGACCGTGAATCTCTGTGGCGGTTCGTTCTGGTTACCTGCTGGCGGGTCT<br>GCCGGACCAGCTGTCTTCTTCTTTCATCAACCTGCCGATCATCACCCGAGAAGGTGACCGTCGTCTGATC<br>GACCTGATCCAGTACGACCAGATCAACCGTGACGCGTTCGTTATGCTGGTTACCTCTGCGTTCAAATCTA<br>ACCTGTCTGGTCTGCAGTACCGTGCGAACAAACAGTCTTTCGTTGTTACCCGTACCCTGTCTCCGTACCT<br>GGGTTCTAAACTGGTTTACGTTCCGAAAGACAAAGACTGGCTGTTTCCGTCTCAGATGTTCGAAGGTCGT<br>TTCGCGGACATCCTGCAGTCTGACTACATGGTTTGGAAAGACGCGGTCGTCTGTGCGTTATCGACACCG<br>CGAAACACCTGTCTAACATCAAAAAATCTGTTTTCTCTTCTGAAGAAGTTCTGGCGTTCCTGCGTGAACT<br>GCCGCACCGTACCTTCATCCAGACCGAAGTTCGTGGTCTGGGTGTTAACGTTGACGGTATCGCGTTCAAC<br>AACGGTGACATCCGTCTCTGAAAACCTTCTCTAACTGCGTTCAGGTTAAAGTTTCTGTACCAACACCT<br>CTCTGGTTCAGACCCTGAACCGTTGGTTCGAAGGTGGTAAAGTTTCTCCGCCGTCTATCCAGTTCGAACG<br>TGCGTACTACAAAAAAGACGACCAGATCCACGAAGACGCGGCGAAACGTAAAATCCGTTTCCAGATGC<br>CGGCGACCGAACTGGTTCACGCGTCTGACGACGCGGGTTGGACCCCGTCTTACCTGCTGGGTATCGACC<br>CGGGTGAATACGGTATGGGTCTGTCTCTGGTTTCTATCAACAACGGTAAGTTCTGGACTCTGGTTTCAT<br>CCACATCAACTCTCTGATCAACTTCGCGTCTAAAAAATCTAACCACCAGACCAAAGTTGTTCCGCGTCAG<br>CAGTACAAATCTCCGTACGCGAACTACCTGGAACAGTCTAAAGACTCTGCGGCGGGTGACATCGCGCAC<br>ATCCTGGACCGTCTGATCTACAAACTGAACGCGCTGCCGGTTTTCGAAGCGCTGTCTGGTAACTCTCAGT<br>CTGCGGCGGACCAGGTTTGGACCAAAGTTCTGTCTTTCTACACCTGGGGTGACAACGACGCGCAGAACT<br>CTATCCGTAAACAGCACTGGTTCGGTGCGTCTCACTGGGACATCAAAGGTATGCTGCGTCAGCCGCCGA<br>CCGAAAAAAACCGAAACCGTACATCGCGTTCCCGGGTTCTCAGGTTTCTTCTTACGGTAACTCTCAGCG<br>TTGCTCTTGCTGCGGTCGTAACCCGATCGAACAGCTGCGTGAAATGGCGAAAGACACCTCTATCAAAGA<br>ACTGAAAATCCGTAACTCTGAAATCCAGCTGTTCGACGGTACCATCAAACTGTTCAACCCGGACCGTCT<br>ACCGTTATCGAACGTCGTCGTCACAACCTGGGTCCGTCTCGTATCCCGGTTGCGGACCGTACCTTCAAAA<br>ACATCTCTCCGTCTTCTCTGGAATTCAAAGAACTGATCACCATCGTTTCTCGTTCTATCCGTCACTCTCCG<br>GAATTCATCGCGAAAAACGTGGTATCGGTTCTGAATACTTCTGCGCGTACTCTGACTGCAACTCTTCTC<br>TGAACTCTGAAGCGAACGCGGCGGCGAACGTTGCGCAGAAATTCCAGAAACAGCTGTTCTTCGAACTGT<br>AAGAAATCATCCTTAGCGAAAGCTAAGGATTTTTTTTATCTGAAATGTAGGGAGACCCTCAGGTTAAAT<br>ATTCACTCAGGAAGTTATTACTCAGGAAGCAAAGAGGATTACA |
| SEQ ID NO: 77 | AATCAGGAGAGCGTTTTCAATCCTACCTCTGGCGCAGTTGATATGTCAAACAGGTTGCCGTCACTGCGTC<br>TTTTACTGGCTCTTCTCGCTAACCAAACCGGTAACCCCGTTTAAAAGCATTCTGTAACAAAGCGGGA<br>CCAAAGCCATGACAAAAACGCGTAACAAAAGTGTCTATAATCACGGCAGAAAAGTCCACATTGATTATT<br>TGCACGGCGTCACACTTTGCTATGCCATAGCATTTTTATCCATAAGATTAGCGGATCCTACCTGACGCTT<br>TTTATCGCAACTCTCTACTGTTTCTCCATACCCGTTTTTTGGGCTAGCAGTAATACGACTCACTATAGGG<br>GTCTCATCTCGTGTGAGATAGGCGGAGATACGAACTTTAAGAGGAGGATATACCATGCACCATCATCAT<br>CACCATAAACGTATCCTGAACTCTCTGAAAGTTGCGGCGCTGCGTCTGCTGTTCCGTGGTAAAGGTTCTG<br>AACTGGTTAAAACCGTTAAATACCCGCTGGTTTCTCCGGTTCAGGGTGCGGTTGAAGAACTGGCGGAAG<br>CGATCCGTCACGACAACCTGCACCTGTTCGGTCAGAAAGAAATCGTTGACCTGATGGAAAAAGACGAAG<br>GTACCCAGGTTTACTCTGTTGTTGACCTTGGCTGGACACCCTGCGTCTGGGTATGTTCTTCTCCGTCT<br>GCGAACGCGCTGAAAATCACCCTGGGTAAATTCAACTCTGACCAGGTTTCTCCGTTCCGTAAAGTTCTGG<br>AACAGTCTCCGTTCTTCCTGGCGGGTCGTCTGAAAGTTGAACCGGCGGAACGTATCCTGTCTGTTGAAAT<br>CCGTAAAATCGGTAAACGTGAAACCGTGTTGAAAACTACGCGGCGACGTTGAAACCTGCTTCATCGG<br>TCAGCTGTGTCTTCTGACGAAAAACAGTCTATCCAGAAACTGGCGAACGACATCTGGGACTCTAAAGACCA<br>CGAAGAACAGCGTATGCTGAAAGCGGACTTCTTCGCGATCCCGCTGATCAAAGACCCGAAAGCGGTTAC |

TABLE 5-continued

| SEQ ID NO | Sequence |
|---|---|
| | CGAAGAAGACCCGGAAAACGAAACCGCGGGTAAACAGAAACCGCTGGAACTGTGCGTTTGCCTGGTTC<br>CGGAACTGTACACCCGTGGTTTCGGTTCTATCGCGGACTTCCTGGTTCAGCGTCTGACCCTGCTGCGTGA<br>CAAAATGTCTACCGACACCGCGGAAGACTGCCTGGAATACGTTGGTATCGAAGAAGAAAAGGTAACG<br>GTATGAACTCTCTGCTGGGTACCTTCCTGAAAAACCTGCAGGGTGACGGTTTCGAACAGATCTTCCAGTT<br>CATGCTGGGTTCTTACGTTGGTTGGCAGGGTAAAGAAGACGTTCTGCGTGAACGTCTGGACCTGCTGGC<br>GGAAAAAGTTAAACGTCTGCCGAAACCGAAATTCGCGGGTAATGGTCTGGTCACCGTATGTTCCTGCA<br>CGGTCAGCTGAAATCTTGGTCTTCTAACTTCTTCCGTCTGTTCAACGAAACCCGTGAACTGCTGGAATCT<br>ATCAAATCTGACATCCAGCACGCGACCATGCTGATCTCTTACGTTGAAGAAAAAGGTGGTTACCACCCG<br>CAGCTGCTGTCTCAGTACCGTAAACTGATGGAACAGCTGCCGGCGCTGCGTACCCAAAGTTCTGGACCCG<br>GAAATCGAAATGACCCACATGTCTGAAGCGGTTCGTTCTTACATCATGATCCACAAATCTGTTGCGGGTT<br>TCCTGCCGGACCTGCTGGAATCTCTGGACCGTGACAAAGACCGTGAATTCCTGCTGTCTATCTTCCCGCG<br>TATCCCGAAAATCGACAAAAAAACCAAAGAAATCGTTGCGTGGGAACTGCCGGGTGAACCGGAAGAAG<br>GTTACCTGTTCACCGCGAACAACCTGTTCCGTAACTTCCTGGAAACCCGAAACACGTTCCGCGTTTCAT<br>GGCGGAACGTATCCCGGAAGACTGGACCCGTCTGCGTTCTGCGCCGGTTTGGTTCGACGGTATGGTTAA<br>ACAGTGGCAGAAAGTTGTTAACCAGCTGGTTGAATCTCCGGGTGCGCTGTACCAGTTCAACGAATCTTTC<br>CTGCGTCAGCGTCTGCAGGCGATGCTGACCGTTTACAAACGTGACCTGCAGACCGAAAAATTCCTGAAA<br>CTGCTGGCGGACGTTTGCCGTCCGCTGGTTGACTTCTTCGGTCTGGGTGGTAACGACATCATCTTCAAAT<br>CTTGCCAGGACCCGCGTAAACAGTGGCAGACCGTTATCCCGCTGTCTGTTCCGGCGGACGTTTACACCGC<br>GTGCGAAGGTCTGGCGATCCGTCTGCGTGAAACCCTGGGTTTCGAATGGAAAACCTGAAAGGTCACGA<br>ACGTGAAGACTTCCTGCGTCTGCACCAGCTGCTGGGTAACCTGCTGTTCTGGATCCGTGACGCGAAACTG<br>GTTGTTAAACTGGAAGACTGGATGACAACCCGTGCGTTCAGGAATACGTTGAAGCGCGTAAAGCGATC<br>GACCTGCCGCTGGAAATCTTCGGTTTCGAAGTTCCGATCTTCCTGAACGGTTACCTGTTCTCTGAACTGC<br>GTCAGCTGGAACTGCTGCTGCGTCGTAAATCTGTTATGACCTCTTACTCTGTTAAAACCACCGGTTCTCC<br>GAACCGTCGTTCCAGCTGGTTTACCTGCCGCTGAAACCCGTCTGACCCGGAAAAAAAAACTCTAACAA<br>CTTCCAGGAACGTCTGGACACCCCGACCGGTCTGTCTCGTCGTTTCCTGGACCTGACCCTGGACGCGTTC<br>GCGGGTAAACTGCTGACCGACCCGGTTACCCAGGAACTGAAACCATGGCGGGTTTCTACGACCACCTG<br>TTCGGTTTCAAACTGCCGTGCAAACTGGCGGCGATGTCTAACCACCCGGGTTCTTCTTCTAAAATGGTTG<br>TTCTGGCGAAACCGAAAAAGGTGTTGCGTTAACATCGGTTTCGAACCGATCCCGGACCCGGCGCACC<br>CGGTTTTCCGTGTTCGTTCTTCTTGGCCGGAACTGAAATACCTGGAAGGTCTGCTGTACCTGCCGGAAGA<br>CACCCCGCTGACCATCGAACTGGCGGAAACCCTGTGTTTCTTGCCAGTCTGTTTCTTCGTTGCGTTCGACC<br>TGAAAAACCTGACCACCATCCTGGGTCGTGTTGGTGAATTCCGTGTTACCGCGGACCAGCCGTTCAAACT<br>GACCCCGATCATCCCGGAAAAAGAAGAATCTTTCATCGGTAAAACCTACCTGGGTCTGGACGCGGGTGA<br>ACGTTCTGGTGTTGGTTTCGCGATCGTTACCGTTGACGGTGACGGTTACGAAGTTCAGCGTCTGGGTGTT<br>CACGAAGACACCCAGCTGATGGCGCTGCAGCAGGTTGCGTCTAAATCTCTGAAAGAACCGGTTTTCCAG<br>CCGCTGCGTAAAGGTACCTTCCGTCAGCAGGAACGTATCCGTAAATCTCTGCGTGGTTCGTACTGGAACT<br>TCTACCACGCGCTGATGATCAAATACCGTGCGAAAGTTGTTCACGAAGAATCTGTTGGTTCTTCTGGTCT<br>GGTTGGTCAGTGGCTGCGTGCGTTCCAGAAAGACCTGAAAAAAGCGGACGTTCTGCCGAAAAAAGGTG<br>GTAAAACGTGTTGACAAAAAAAAACGTGAATCTTCTGCGCAGGACACCCTGTGGGGTGGTGCGTTCT<br>CTAAAAAAGAAGAACAGCAGATCGCGTTCGAAGTTCAGGCGGCGGGTTCTTCTCAGTTCTGCCTGAAAT<br>GCGGTTGGTGGTTCCAGCTGGGTATGCGTGAAGTTAACCGTGTTCAGGAATCTGGTGTTGTTCTGGACTG<br>GAACCGTTCTATCGTTACCTTCCTGATCGAATCTTCTGGTGAAAAAGTTTACGGTTTCTCTCCGCAGCAG<br>CTGGAAAAAGGTTTCCGTCCGGACATCGAAACCTTCAAAAAAATGGTTCGTGACTTCATGCGTCCGGACA<br>ATGTTCGACCGTAAAGGTCGTCCGGCGGCGGCGTACGAACGTTTCGTTCTGGGTCGTCGTCACCGTCGTT<br>ACCGTTTCGACAAAGTTTTCGAAGAACGTTTCGGTCGTTCTGCGCTGTTCATCTGCCCGCGTGTTGGTTGC<br>GGTAACTTCGACCACTCTTCTGAACAGTCTGCGGTTGTTCTGGCGCTGATCGGTTACATCGCGGACAAAG<br>AAGGTATGTCTGGTAAAAAACTGGTTTACGTTCGTCTGGCGGAATCTGGCGGAATGGAAACTGAAAA<br>AACTGGAACGTTCTCGTGTTGAAGAACAGTCTTCTGCGCAGTAAGAAATCATCCTTAGCGAAAGCTAAG<br>GATTTTTTTTATCTGAAATGTAGGGAGACCCTCAGGTTAAATATTCACTCAGGAAGTTATTACTCAGGAA<br>GCAAAGAGGATTACA |
| SEQ ID NO: 78 | AATCAGGAGAGCGTTTTCAATCCTACCTCTGGCGCAGTTGATATGTCAAACAGGTTGCCGTCACTGCGTC<br>TTTTACTGGCTCTTTCTCGCTAACCAAACCGGTAACCCCGCTTATTAAAAGCATTCTGTAACAAAGCGGGA<br>CCAAAGCCATGACAAAAACGCGTAACAAAAGTGTCTATAATCACGGCAGAAAAGTCCACATTGATTATT<br>TGCACGGCGTCACACTTTGCTATGCCATAGCATTTTTATCCATAAGATTAGCGGATCCTACCTGACGCTT<br>TTTATCGCAACTCTCTACTGTTTCTCCATACCCGTTTTTTTGGGCTAGCAGTAATACGACTCACTATAGGG<br>GTCTCATCTCGTGTGAGATAGGCGGAGATACGAACTTTAAGAGGAGGATATACCATGCACCATCATCAT<br>CACCATGCGGAATCTAAACAGATGCAGTGCCGTAAATGCGGTGCGTCTATGAAATACGAAGTTATCGGT<br>CTGGGTAAAAAATCTTGCCGTTACATGTGCCGGACTGCGGTAACCACACCTCTGCGCGTAAAATCCAG<br>AACAAAAAAAACGTGACAAAAAAATACGGTTCTGCGTCTAAAGCGCAGTCTCAGCGTATCGCGGTTGCG<br>GGTGCGCTGTACCCGGACAAAAAAGTTCAGACCATCAAAACCTACAAATACCCGGCGGACCTGAACGGT<br>GAAGTTCACGACTCTGGTGTTGCGGAAAAAATCGCGCAGGCGATCCAGGAAGACGAAATCGGTCTGCTG<br>GGTCCGTCTTCTGAATACGCGTGCTGGATCGCGTCTCAGAAACAGTCTGAACCGTACTCTGTTGTTGACT<br>TCTGGTTCGACGCGGTTTGCGCGGGTTGTGTTTTCGCGTACTGCTGTCTGTCTACCGACTGCTT<br>CAGCTGTCTGGTGAAGAATCTGTTCTGCGTGCGGCGCTGGCGTCTTCTCCGTTCGTTGACGACATCAACC<br>TGGCGCAGGCGGAAAATTCCTGGCGGTTTCTCGTCGTACCGGTCAGGACAAACTGGGTAAACGTATCG<br>GTGAATGCTTCGCGGAAGGTCGTCTGGAAGCGCTGGGTATCAAAGACCGTATGCGTGAATTCGTTCAGG<br>CGATCGACGTTGCGCAGACCGCGGGTCACGCGTTTCGCGGCGAACTGAAATGTAAACTCTTCGGTATCTCTCAGA<br>TGCCGGAAGCGAAACAGTGGAACAACGACTCTGGTCTGACCGTTTGCATCCTGCCGGACTACTACGTTC<br>CGGAAGAAAACCGTGCGGACCAGCTGGTTGTTCTGCGTCGTCTGCGTGAAATCGCGTACTGCATGG<br>GTATCGAAGACGAAGCGGGTTTCGAACACCTGGGTATCGACCCGGGTGCGCTGTCTAACTTCTCTAACG<br>GTAACCCGAAACGTGGTTTCCTGGGTCGTCTGCTGAACAACAGCATCATCGCGTGGCGAACAACATGT<br>CTGCGATGACCCCGTACTGGGAAGGTCGTAAAGGTGAACTGATCGAACGTCTGGCGTGGCTGAAACACC<br>GTGCGGAAGGTCTGTACCTGAAAGAACCGCACTTCGGTAACTCTTGGGCGGACCACCGTTCTCGTATCTT<br>CTCTCGTATCGCGGGTTGGCTGTCTGGTTGCGCGGGTAAACTGAAAATCGCGAAAGACCAGATCTCTGG<br>TGTTCGTACCGACCTGTTCCTGCTGAAACGTCTGCTGGACGCGGTTCCGCAGTCTGCGCCGTCTCCGGAC<br>TTCATCGCGTCTATCTCTGCGCTGGACCGTTTCCTGGAAGCGGCGGAATCTTCTCAGGACCCGGCGGAAC |

TABLE 5-continued

| SEQ ID NO | Sequence |
|---|---|
| | AGGTTCGTGCGCTGTACGCGTTCCACCTGAACGCGCCGGCGGTTCGTTCTATCGCGAACAAAGCGGTTCA<br>GCGTTCTGACTCTCAGGAATGGCTGATCAAAGAACTGGACGCGGTTGACCACCTGGAATTCAACAAAGC<br>GTTCCCGTTCTTCTCTGACACCGGTAAAAAAAAAAAAAAAGGTGCGAACTCTAACGGTGCGCCGTCTGA<br>AGAAGAATACACCGAAACCGAATCTATCCAGCAGCCGGAAGACGCGGTTGACCACCAGGAAGTTAACGGTCAGG<br>AAGGTAACGGTGCGTCTAAAAACCAGAAAAAATTCCAGCGTATCCCGCGTTTCTTCGGTGAAGGTTCTC<br>GTTCTGAATACCGTATCCTGACCGAAGCGCCGCAGTACTTCGACATGTTCTGCAACAACATGCGTGCGAT<br>CTTCATGCAGCTGGAATCTCAGCCGCGTAAAGCGCCGCGTGACTTCAAATGCTTCCTGCAGAACCGTCTG<br>CAGAAACTGTACAAACAGACCTTCCTGAACGCGCGTTCTAACAAATGCCGTGCGCTGCTGGAATCTGTT<br>CTGATCTCTTGGGGTGAATTCTACACCTACGGTGCGAACGAAAAAAAATTCCGTCTGCGTCACGAAGCG<br>TCTGAACGTTCTTCTGACCCGGACTACGTTGTTCAGCAGGCGCTGGAAATCGCGCGTCGTCTGTTCCTGT<br>TCGGTTTCGAATGGCGTGACTGCTCTGCGGGTAACGTGTTGACCTGGTTGAAATCCACAAAAAAGCGA<br>TCTCTTTCCTGCTGGCGATCACCCAGGCGGAAGTTTCTGTTGGTTCTTACAACTGGCTGGGTAACTCTACC<br>GTTTCTCGTTACCTGTCTGTTGCGGGTACCGACACCCTGTACGGTACCCAGCTGGAAGAATTCCTGAACG<br>CGACCGTTCTGTCTCAGATGCGTGGTCTGGCGATCCGTCTGTCTTCTCAGGAACTGAAAGACGGTTTCGA<br>CGTTCAGCTGGAATCTTCTTGCCAGGACAACCTGCAGCACCTGCTGGTTTACCGTGCGTCTCGTGACCTG<br>GCGGCGTGCAAACGTGCGACCTGCCCGGCGGAACTGGACCCGAAATCCTGGTTCTGCCGGTTGGTGCG<br>TTCATCGCGTCTGTTATGAAAATGATCGAACGTGGTGACGAACCGCTGGCGGGTGCGTACCTGCGTCAC<br>CGTCCGCACTCTTTCGGTTGGCAGATCCGTGTTCGTGGTGTTGCGGAAGTTGGTATGGCACAGGGTACCG<br>CGCTGGCGTTCCAGAAACCGACCGAATCTGAACCGTTCAAAATCAAACCGTTCTCTGCGCAGTACGGTC<br>CGGTTCTGTGGCTGAACTCTTCTTCTTACTCTCAGTCTCAGTACCTGGACGGTTTCCTGTCTCAGCCGAAA<br>AACTGCTATCGTGTTCTGCCGCAGGCGGGTTCTGTTCGTGTTGAACAGCGTGTTGCGCTGATCTGGA<br>ACCTGCAGGCGGGTAAAATGCGTCTGGAACGTTCTGGTGCGCGTGCGTTCTTCATGCCGGTTCCGTTCTC<br>TTTCCGTCCGTCTGGTTCTGGTGACGAAGCGGTTCTGGCGCCGAACCGTTACCTGGGTCTGTTCCCGCAC<br>TCTGGTGGTATCGAATACGCGGTTGTTGACGTTCTGGACTCTGCGGGTTTCAAAATCCTGGAACGTGGTA<br>CCATCGGTTAACGGTTCTCTCAGAAACGTGGTGAACGTCAGGAAGAAGCGCACCGTGAAAAACAGC<br>GTCGTGGTATCTCTGACATCGGTCGTAAAAAACCGGTTCAGGCGGAAGTTGACGCGGCGAACGAACTGC<br>ACCGTAAATACACCGACGTTGCGACCCGTCGGGTTGCCGTATCGTTGTTCAGTGGGCGCCGCAGCCGA<br>AACCGGGTACCGCGCCGACCGCGCAGACCGTTTACGCGCGTGCGGTTCGTACCGAAGCGCCGCGTTCTG<br>GTAACCAGGAAGACCACGCGCGTATGAAATCTTCTTGGGGTTACACTGGGGTACCTACTGGGAAAAAC<br>GTAAACCGGAAGACATCCTGGGTATCTCTACCCAGGTTTACTGGACCGGTGGTATCGGTGAATCTTGCCC<br>GGCGGTTGCGGTTGCGCTGCTGGGTCACATCCGTGCGACCTCTACCCAGACCGAATGGGAAAAAGAAGA<br>AGTTGTTTCGGTCGTCTGAAAAAATTCTTCCCGTCTTAAGAAATCATCCTTAGCGAAAGCTAAGGATTT<br>TTTTTATCTGAAATGTAGGGAGACCCTCAGGTTAAATATTCACTCAGGAAGTTATTACTCAGGAAGCAAA<br>GAGGATTACA |
| SEQ ID NO: 79 | AATCAGGAGAGCGTTTTCAATCCTACCTCTGGCGCAGTTGATATGTCAAACAGGTTGCCGTCACTGCGTC<br>TTTTACTGGCTCTTCTCGCTAACCAAACCGGTAACCCCGCTTATTAAAAGCATTCTGTAACAAAGCGGGA<br>CCAAAGCCATGACAAAAACGCGTAACAAAAGTGTCTATAATCACGGCAGAAAAGTCCACATTGATTATT<br>TGCACGGCGTCACACTTTGCTATGCCATAGCATTTTTATCCATAAGATTAGCGGATCCTACCTGACGCTT<br>TTTATCGCAACTCTCTACTGTTTCTCCATACCCGTTTTTTTGGGCTAGCAGTAATACGACTCACTATAGGG<br>GTCTCATCTCGTGTGAGATAGGCGGAGATACGAACTTTAAGAGGAGGATATACCATGCACCATCATCAT<br>CACCATGAAAACGTATCAACAAATCCGTAAAAAACTGTCTGCGACAACGCGACCAAACCGGTTTCT<br>CGTTCTGGTCCGATGAAAACCCTGCTGGTTCGTGTTATGACCGACGACCTGAAAAAACGTCTGGAAAAA<br>CGTCGTAAAAAACCGGAAGTTATGCCGCAGGTTATCTCTAACAACGCGGCGAACAACCTGCGTATGCTG<br>CTGGACGACTACACCAAAATGAAAGAAGCGATCCTGCAGGTTTACTGGCAGGAATTCAAAGACGACCA<br>CGTTGGTCTGATGTGCAAATTCGCGCAGCCGGCGTCTAAAAAATCGACCAGAACAAATGAAACCGGA<br>AATGGACGAAAAAGGTAACCTGACCACCGCGGGTTTCGCGTGCTCTCAGTGCGGTCAGCCGCTGTTCGT<br>TTACAAACTGGAACAGGTTTCTGAAAAAGGTAAAGCGTACACCAACTACTTCGGTCGTTGCAACGTTGC<br>GGAACACGAAAAACTGATCCTGCTGGCGCAGCTGAAACCGGAAAAAGACTCTGACGAAGCGGTTACCT<br>ACTCTCTGGGTAAATTCGGTCAGCGTGCTGGACTTCTACTCTATCCACGTTACCAAAGAATCTACCCA<br>CCCGGTTAAACCGCTGGCGCAGATCGCGGGTAACCGTTACGCGTCTGGTCCGGTTGGTAAAGCGCTGTC<br>TGACGCGTGCATGGGTACCATCGCGTCTTTCCTGTCTAAATACCAGGACATCATCATCGAACACCAGAA<br>AGTTGTTAAAGGTAACCAGAAACGTCTGGAATCTCTGCGTGAACTGGCGGGTAAAGAAAACCTGGAATA<br>CCCGTCTGTTACCCTGCCGCCGCAGCCGCACACCAAAGAAGGTGTTGACGTACAAGGAAGTTATCGC<br>GCGTGTTCGTATGTGGGTTAACCTGAACCTGTGGCAGAAACTGAAACTGTCTCGTGACGACGCGAAACC<br>GCTGCTGCGTCTGAAAGGTTTCCCGTCTTTCCCGGTTGTTGAACGTCGTGAAAACGAAGTTGACTGGTGG<br>AACACCATCAACGAAGTTAAAAAACTGATCGACGCGAAACGTGACATGGGTCGTGTTTTCTGGTCTGGT<br>GTTACCGCGGAAAACGTAACACCATCCTGGAAGGTTACAACTACCTGCCGAACGAAAACGACCACAA<br>AAAACGTGAAGGTTCTCTGGAAAACCCGAAAAAACCGGCGAACGTCAGTTCGGTGACCTGCTGCTGTA<br>CCTGGAAAAAAATACGCGGGTGACTGGGGTAAAGTTTTCGACGAAGCGTGGGAACGTATCGACAAAA<br>AAATCGCGGGTCTGACCTCTCACATCGAACGTGAAGAAGCGCGTAACGCGGAAGACGCGCAGTCTAAA<br>GCGGTTCTGACCGACTGGCTGCGTGCGAAAGCGTCTTTCGTTCTGGAACGTCTGAAAGAAATGGACGAA<br>AAAGAATTCTACGCGTGCGAAATCCAGCTGCAGAAATGTGACCGTGCGTGGTAACCCGTTCGCG<br>GTTGAAGCGGAAACCGTGTTGTTGACATCTCTGGTTTCTCTATCCGGTTCTGACGGTCACTCTATCCAGT<br>ACCGTAACCTGCTGGCGTGGAAATACCTGGAAAACGGTAAACGTGAATTCTACCTGCTGATGAACTACG<br>GTAAAAAGGTCGTATCCGTTTCACCGACGGTACCGACATCAAAAAATCTGGTAAATGGCAGGGTCTGC<br>TGTACGGTGGTGGTAAAGCGAAAGTTATCGACCTGACCTTCGACCCGGACGACGAACAGCTGATCATCC<br>TGCCGCTGGCGTTCGGTACCCGTCAGGGTCGTGAATTCATCTGGAAGACCTGCTGTCTCTGGAAACCGG<br>TCTGATCAAACTGGCGAACGGTCGTGTTATCGAAAAACCATCTACAACAAAAAATCGGTCGTGACGA<br>ACCGGCGCTGTTCGTTGCGCTGACCTTCGAACGTCGTGAAGTTGTTGACCCGTCTAACATCAAACCGGTT<br>AACCTGATCGGTGTTGACCGTGGTGAAAACATCCCGGCGGTTATCGCGCTGACCGACCGGCAGGAATTGC<br>CCGCTGCCGGAATTCAAAGACTCTTCTGGTGGTCCGACCGACATCCGTGCGTATCGGTCAGCCGGTACAAA<br>GAAAAACAGCGTGCGATCCAGGCGGCGAAAGAAGTTAACAGCGTCGTGCGGGTGGTTACTCTCGTAA<br>ATTCGCGTCTAAATCTCGTAACCTGGCGGACGACATGGTTCGTAACTCTGCGCGTGACCTGTTCTACCAC<br>GCGGTTACCCACGACGCGGTTCTGTTTTCGAAAACCTGTCTCGTGGTTCGGTCGTCAGGGTAAACGTA<br>CCTTCATGACCGAACGTCAGTACACCAAAATGGAAGACTGGCTGACCGCGAAACTGGCGTACGAAGGTC |

TABLE 5-continued

| SEQ ID NO | Sequence |
|---|---|
| | TGACCTCTAAAACCTACCTGTCTAAAACCCTGGCGCAGTACACCTCTAAAACCTGCTCTAACTGCGGTTT<br>CACCATCACCACCGCGGACTACGACGGTATGCTGGTTCGTCTGAAAAAAACCTCTGACGGTTGGGCGAC<br>CACCCTGAACAACAAAGAACTGAAAGCGGAAGGTCAGATCACCTACTACAACCGTTACAAACGTCAGA<br>CCGTTGAAAAAGAACTGTCTGCGGAACTGGACCGTCTGTCTGAAGAATCTGGTAACAACGACATCTCTA<br>AATGGACCAAAGGTCGTCGTGACGAAGCGCTGTTCCTGCTGAAAAAACGTTTCTCTCACCGTCCGGTTCA<br>GGAACAGTTCGTTTGCCTGGACTGCGGTCACGAAGTTCACGCGGACGAACAGGCGGCGCTGAACATCGC<br>GCGTTCTTGGCTGTTCCTGAACTCTAACTCTACCGAATTCAAATCTTACAAATCTGGTAAACAGCCGTTC<br>GTTGGTGCGTGGCAGGCGTTCTACAAACGTCGTCTGAAAGAAGTTTGGAAACCGAACGCGTAAGAAATC<br>ATCCTTAGCGAAAGCTAAGGATTTTTTTTATCTGAAATGTAGGGAGACCCTCAGGTTAAATATTCACTCA<br>GGAAGTTATTACTCAGGAAGCAAAGAGGATTACA |
| SEQ ID NO: 80 | AATCAGGAGAGCGTTTTCAATCCTACCTCTGGCGCAGTTGATATGTCAAACAGGTTGCCGTCACTGCGTC<br>TTTTACTGGCTCTTCTCGCTAACCAAACCGGTAACCCCGCTTATTAAAAGCATTCTGTAACAAAGCGGGA<br>CCAAAGCCATGACAAAAACGCGTAACAAAAGTGTCTATAATCACGGCAGAAAAGTCCACATTGATTATT<br>TGCACGGCGTCACACTTTGCTATGCCATAGCATTTTTATCCATAAGATTAGCGGATCCTACCTGACGCTT<br>TTTATCGCAACTCTCTACTGTTTCTCCATACCCGTTTTTTTGGGCTAGCAGTAATACGACTCACTATAGGG<br>GTCTCATCTCGTGTGAGATAGGCGGAGATACGAACTTTAAGAGGAGGATATACCATGCACCATCATCAT<br>CACCATAAACGTATCAACAAAATCCGTCGTCGTCTGGTTAAAGACTCTAACACCAAAAAAGCGGGTAAA<br>ACCGGTCCGATGAAAACCCTGCTGGTTCGTGTTATGACCCCGGACCTGCGTGAACGTCTGGAAAACCTG<br>CGTAAAAAACCGGAAAACATCCCGCAGCCGATCTCTAACACCTCTCGTGCGAACCTGAACAAACTGCTG<br>ACCGACTACACCGAAATGAAAAAAGCGATCCTGCACGTTTACTGGGAAGAATTCCAGAAAGACCCGGTT<br>GGTCTGATGTCTCGTGTTGCGCAGCCGGCGCCGAAAAACATCGACCAGCGTAAACTGATCCCGGTTAAA<br>GACGGTAACGAACGTCTGACCTCTTCTGGTTTCGCGTGCTCTCAGTGCTGCCAGCCGCTGTACGTTTACA<br>AACTGGAACAGGTTAACGACAAAGGTAAACCGCACACCAACTACTTCGGTCGTTGCAACGTTTCTGAAC<br>ACGAACGTCTGATCCTGCTGTCTCCGCACAAACCGGAAGCGAACGACGAACTGGTTACCTACTCTCTGG<br>GTAAATTCGGTCAGCGTGCGCTGGACTTCTACTCTATCCACGTTACCCGTGAATCTAACCACCCGGTTAA<br>ACCGCTGGAACAGATCGGTGGTAACTCTTGCGCGTCTGGTCCGGTTGGTAAAGCGCTGTCTGACGCGTG<br>CATGGGTGCGGTTGCGTCTTTCCTGACCAAATACCAGGACATCATCCTGGAACACCAGAAAGTTATCAA<br>AAAAAACGAAAACGTCTGGCGAACCTGAAAGACATCGCGTCTGCGAACGGTCTGGCGTTCCCGAAAA<br>TCACCCTGCCGCCGCAGCCGCACACCAAAGAAGGTATCGAAGCGTACAACAACGTTGTTGCGCAGATCG<br>TTATCTGGGTTAACCTGAACCTGTGGCAGAAACTGAAAATCGGTCGTGACGAAGCGAAACCGCTGCAGC<br>GTCTGAAAGGTTTCCCGTCTTTCCCGCTGGTTGAACGTCAGGCGAACGAAGTTGACTGGTGGGACATGGT<br>TTGCAACGTTAAAAAACTGATCAACGAAAAAAAAGAAGACGGTAAAGTTTTCTGGCCAGAACCTGGCGG<br>GTTACAAACGTCAGGAAGCGCTGCTGCCGTACCTGTCTTCTGAAGAAGACCGTAAAAAAAGGTAAAAAAT<br>TCGCGCGTTACCAGTTCGGTGACCTGCTGCTGCACCTGGAAAAAAAAACACGGTGAAGACTGGGGTAAAG<br>TTTACGACGAAGCGTGGGAACGTATCGACAAAAAAGTTGAAGGTCTGTCTAAACACATCAAACTGGAAG<br>AAGAACGTCGTTCTGAAGACGCGCAGTCTAAAGCGGCGCTGACCGACTGGCTGCGTGCGAAAGCGTCTT<br>TCGTTATCGAAGGTCTGAAAGAAGCGGACAAAGACGAATTCTGCCGTTGCGAACTGAAACTGCAGAAAT<br>GGTACGGTGACCTGCGTGGTAAACCGTTCGCGATCGAAGCGGAAAACTCTATCCTGGACATCTCTGGTTT<br>CTCTAAACAGTACAACTGCGCGTTCATCTGGCAGAAAGACGGTGTTAAAAAACTGAACCTGTACCTGAT<br>CATCAACTACTTCAAAGGTGGTAAACTGCGTTTCAAAAAAATCAAACCGGAAGCGTTCGAAGCGAACCG<br>TTTCTACACCGTTATCAACAAAAATCTGGTGAAATCGTTCCAGATGAAGTTAACTTCAACTTCGACGAC<br>CCGAACCTGATCATCCTGCCGCTGGCGTTCGGTAAACGTCAGGGTCGTGAATTCATCTGGAACGACCTGC<br>TGTCTCTGGAAACCGGTTCTCTGAAACTGGCGAACGGTCGTGTTATCGAAAAAACCCTGTACAACCGTC<br>GTACCCGTCAGGACGAACCGGCGCTGTTCGTTGCGCTGACCTTCGAACGTCGTGAAGTTCTGGACTCTTC<br>TAACATCAACGATGAACCTGATCGGTATCGACCGTGGTGAAAACCATCCCGGCGGTTATCGCGCTGAC<br>CGACCCGGAAGGTTGCCCGCTGTCTCGTTTCAAAGACTCTCTGGGTAACCCGACCCACATCCTGCGTATC<br>GGTGAATCTTACAAAGAAAAACAGCGTACCATCCAGGCGGCGAAAGAAGTTGAACAGCGTCGTGCGGG<br>TGGTTACTCTCGTAAATACGCGTCTAAAGCGAAAAACCTGGCGGACGACATGGTTCGTAACACCGCGCG<br>TGACCTGCTGTACTACGCGGTTACCCAGGACGCGATGCTGATCTTCGAAAACCTGTCTCGTGGTTTCGGT<br>CGTCAGGGTAAACGTACCTTCATGGCGGAACGTCAGTACACCCGTATGGAAGACTGGCTGACCGCGAAA<br>CTGGCGTACGAAGGTCTGCCGTCTAAAACCTACCTGTCTAAAACCCTGGCGCAGTACACCTCTAAAACCT<br>GCTCTAACTGCGGTTTCACCATCACCTCTGCGGACTACGACCGTGTTCTGGAAAAACTGAAAAAAACCG<br>CGACCGGTTGGATGACCACCATCAACGGTAAAGAACTGAAAGTTGAAGGTCAGATCACCTACTACAACC<br>GTTACAAACGTCAGAACGTTGTTAAAGACCTGTCTGTTGAACTGGACCGTCTGTCTGAAGAATCTGTTAA<br>CAACGACATCTCTTCTTGGACCAAAGGTCGTTCTGGTGAAGCGCTGTCTCTGCTGAAAAAACGTTTCTCT<br>CACCGTCCGGTTCAGGAAAAATTCGTTTGCCTGAACTGCGGTTTCGAAACCCACGCGGACGAACAGGCG<br>GCGCTGAACATCGCGCGTTCTTGGCTGTTCCTGCGCTTCTCAGGAATACAAAAAATACCAGACCAACAAA<br>ACCACCGGTAACACCGACAAACGTGCGTTCGTTGAAACCTGGCAGTCTTTCTACCGTAAAAAACTGAAA<br>GAAGTTTGGAAACCGGAAATCATCCTTAGCGAAAGCTAAGGATTTTTTTATCTGAAATGTAGGGAGAC<br>CCTCAGGTTAAATATTCACTCAGGAAGTTATTACTCAGGAAGCAAAGAGGATTACA |
| SEQ ID NO: 81 | tgccgtcactgcgtctttactggctcttctcgctaaccaaaccggtaaccccgcttattaaaagcattctgtaacaaagcgggaccaaagccatgaca<br>aaaacgcgtaacaaaagtgtctataatcacggcagaaaagtccacattgattatttgcacggcgtcacactttgctatgccatagcatttttatccata<br>agattagcggatcctacctgacgcttttatcgcaactctctactgtttctccatacccgttttttgggctagcaccgcctatctcgtgtgagatagg<br>cggagatacgaactttaagAAGGAGatatacc |
| SEQ ID NO: 82 | TGCCGTCACTGCGTCTTTTACTGGCTCTTCTCGCTAACCAAACCGGTAACCCCGCTTATTAAAAGCATTCT<br>GTAACAAAGCGGGACCAAAGCCATGACAAAAACGCGTAACAAAAGTGTCTATAATCACGGCAGAAAAG<br>TCCACATTGATTATTTGCACGGCGTCACACTTTGCTATGCCATAGCATTTTTATCCATAAGATTAGCGGAT<br>CCTACCTGACGCTTTTTATCGCAACTCTCTACTGTTTCTCCATACCCGTTTTTTTGGGCTAGCGGATCCTAC<br>CTGAC |
| SEQ ID NO: | AATCAGGAGAGCGTTTTCAATCCTACCTCTGGCGCAGTTGATATGTCAAACAGGTTTCTAGAGCACAGCT<br>AACACCACGTCGTCCCTATCTGCTGCCCTAGGTCTATGAGTGGTTGCTGGATAACTTTACGGGCATGCAT<br>AAGGCTCGTAATATATATTCAGGGAGACCACAACGGTTTCCCTCTACAAATAATTTTGTTTAACTTTTAC |

TABLE 5-continued

| SEQ ID NO | Sequence |
|---|---|
| 83 | TAGAGCTAGCAGTAATACGACTCACTATAGGGTCTCATCTCGTGTGAGATAGGCGGAGATACGAACTTTAAGAGGAGGATATACCA |
| 84 | GTTTGAGAGATATGTAAATTCAAAGGATAATCAAAC |
| 85 | actacattttttaagacctaattttgagt |
| 86 | ctcaaaactcattcgaatctctactctttgtagat |
| 87 | CTCTAGCAGGCCTGGCAAATTTCTACTGTTGTAGAT |
| 88 | CCGTCTAAAACTCATTCAGAATTTCTACTAGTGTAGAT |
| 89 | GTCTAGGTACTCTCTTTAATTTCTACTATTGT |
| 90 | gttaagttatatagaataatttctactgttgtaga |
| 91 | gtttaaaaccactttaaaatttctactattgta |
| 92 | GTTTGAGAATGATGTAAAAATGTATGGTACACAGAAATGTTTTAATACCATATTTTTACATCACTCTCAAACATACATCTCTTGTTACTGTTTATCGTATCCAGATTAAATTTCACGTTTTT |
| 93 | CTCTACAACTGATAAAGAATTTCTACTTTTGTAGAT |
| 94 | GTCTGGCCCCAAATTTTAATTTCTACTGTTGTAGAT |
| 95 | GTCAAAAGACCTTTTTAATTTCTACTCTTGTAGAT |
| 96 | GTCTAGAGGACAGAATTTTTCAACGGGTGTGCCAATGGCCACTTTCCAGGTGGCAAAGCCCGTTGAGCTTCTACGGAAGTGGCAC |
| 97 | CGAGGTTCTGTCTTTTGGTCAGGACAACCGTCTAGCTATAAGTGCTGCAGGGGTGTGAGAAACTCCTATTGCTGGACGATGTCTCTTTTAACGAGGCATTAGCAC |

TABLE 5-continued

| SEQ ID NO | Sequence |
|---|---|
| SEQ ID NO: 98 | GAACGAGGGACGTTTTGTCTCCAATGATTTTGCTATGACGACCTCGAACTGTGCCTTCAAGTCTGAGGCG AAAAAGAAATGGAAAAAAGTGTCTCATCGCTCTACCTCGTAGTTAGAGG |
| SEQ ID NO: 99 | AATTACTGATGTTGTGATGAAGG |
| SEQ ID NO: 100 | TATACCATAAGGATTTAAAGACT |
| SEQ ID NO: 101 | GTCTTTACTCTCACCTTTCCACCTG |
| SEQ ID NO: 102 | ATTTGAAGGTATCTCCGATAAGTAAAACGCATCAAAG |
| SEQ ID NO: 103 | GTTTGAAGATATCTCCGATAAATAAGAAGCATCAAAG |
| SEQ ID NO: 104 | TTGTTTTAATACCATATTTTTACATCACTCTCAAAC |
| SEQ ID NO: 105 | AAAGAACGCTCGCTCAGTGTTCTGACCTTTCGAGCGCCTGTTCAGGGCGAAAACCCTGGGAGGCGCTCG AATCATAGGTGGGACAAGGGATTCGCGGCGAAAA |
| SEQ ID NO: 106 | GTTTGAGAATGATGTAAAAATGTATGGTACACAGAAATGTTTTAATACCATATTTTTACATCACTCTCAA ACATACATCTCTTGTTACTGTTTATCGTATCCAGATTAAATTTCACGTTTTT |
| SEQ ID NO: 107 | GTCTAGAGGACAGAATTTTTCAACGGGTGTGCCAATGGCCACTTTCCAGGTGGCAAAGCCCGTTGAGCT TCTACGGAAGTGGCAC |
| SEQ ID NO: 108 | MSIYQEFVNKYSLSKTLRFELIPQGKTLENIKARGLILDDEKRAKDYKKAKQIIDKYHQFFIEEILSSVC ISEDLLQNYSDVYFKLKKSDDDNLQKDFKSAKDTIKKQISEYIKDSEKFKNLFNQNLIDAKKGQESDLIL WLKQSKDNGIELFKANSDITDIDEALEIIKSFKGWTTYFKGFHENRKNVYSSNDIPTSIIYRIVDDNLPK FLENKAKYESLKDKAPEAINYEQIKKDLAEELTFDIDYKTSEVNQRVFSLDEVFEIANFNNYLNQSGITK FNTIIGGKFVNGENTKRKGINEYINLYSQQINDKTLKKYKMSVLFKQILSDTESKSFVIDKLEDDSDVVT TMQSFYEQIAAFKTVEEKSIKETLSLLFDDLKAQKLDLSKIYFKNDKSLTDLSQQVFDDYSVIGTAVLEY ITQQIAPKNLDNPSKKEQELIAKKTEKAKYLSLETIKLALEEFNKHRDIDKQCRFEEILANFAAIPMIFD EIAQNKDNLAQISIKYQNGKKDLLQASAEDDVKAIKDLLDQTNNLLHKLKIFHISQSEDKANILDKDEH FYLVFEECYFELANIVPLYNKIRNYITQKPYSDEKFKLNFENSTLANGWDKNKEPDNTAILFIKDDKYYL GVMNKKNNKIFDDKAIKENKGEGYKKIVYKLLPGANKMLPKVFFSAKSIKFYNPSEDILRIRNHSTHTKN GSPQKGYEKFEFNIEDCRKFIDFYKQSISKHPEWKDFGFRFSDTQRYNSIDEFYREVENQGYKLTFENIS ESYIDSVVNQGKLYLFQIYNKDFSAYSKGRPNLHTLYWKALFDERNLQDVVYKLNGEAELFYRKQSIPKK ITHPAKEAIANKNKDNPKKESVFEYDLIKDKRFTEDKFFFHCPITINFKSSGANKFNDEINLLLKEKAND VHILSIDRGERHLAYYTLVDGKGNIIKQDTFNIIGNDRMKTNYHDKLAAIEKDRDSARKDWKKINNIKEM KEGYLSQVVHEIAKLVIEYNAIVVFEDLNFGFKRGRFKVEKQVYQKLEKMLIEKLNYLVFKDNEFDKTGG VLRAYQLTAPFETFKKMGKQTGIIYYVPAGFTSKICPVTGFVNQLYPKYESVSKSQEFFSKFDKICYNLD KGYFEFSFDYKNFGDKAAKGKWTIASFGSRLINFRNSDKNHNWDTREVYPTKELEKLLKDYSIEYGHGEC IKAAICGESDKKFFAKLTSVLNTILQMRNSKTGTELDYLISPVADVNGNFFDSRQAPKNMPQDADANGAY HIGLKGLMLLGRIKNNQEGKKLNLVIKNEEYFEFVQNRNN |
| SEQ ID NO: 109 | MSIYQEFVNKYSLSKTLRFELIPQGKTLENIKARGLILDDEKRAKDYKKAKQIIDKYHQFFIEEILSSVC ISEDLLQNYSDVYFKLKKSDDDNLQKDFKSAKDTIKKQISEYIKDSEKFKNLFNQNLIDAKKGQESDLIL WLKQSKDNGIELFKANSDITDIDEALEIIKSFKGWTTYFKGFHENRKNVYSSDDIPTSIIYRIVDDNLPK FLENKAKYESLKDKAPEAINYEQIKKDLAEELTFDIDYKTSEVNQRVFSLDEVFEIANFNNYLNQSGITK FNTIIGGKFVNGENTKRKGINEYINLYSQQINDKTLKKYKMSVLFKQILSDTESKSFVIDKLEDDSDVVT |

TABLE 5-continued

| SEQ ID NO | Sequence |
|---|---|
| | TMQSFYEQIAAFKTVEEKSIKETLSLLFDDLKAQKLDLSKIYFKNDKSLTDLSQQVFDDYSVIGTAVLEY ITQQVAPKNLDNPSKKEQDLIAKKTEKAKYLSLETIKLALEEFNKHRDIDKQCRFEEILANFAAIPMIFD EIAQNKDNLAQISLKYQNQGKKDLLQASAEEDVKAIKDLLDQTNNLLHRLKIFHISQSEDKANILDKDEH FYLVFEECYFELANIVPLYNKIRNYITQKPYSDEKFKLNFENSTLANGWDKNKEPDNTAILFIKDDKYYL GVMNKKNNKIFDDKAIKENKGEGYKKIVYKLLPGANKMLPKVFFSAKSIKFYNPSEDILRIRNHSTHTKN GNPQKGYEKFEFNIEDCRKFIDFYKESISKHPEWKDFGFRFSDTQRYNSIDEFYREVENQGYKLTFENIS ESYIDSVVNQGKLYLFQIYNKDFSAYSKGRPNLHTLYWKALFDERNLQDVVYKLNGEAELFYRKQSIPKK ITHPAKEAIANKNKDNPKKESVFEYDLIKDKRFTEDKFFFHCPITINFKSSGANKFNDEINLLLKEKAND VHILSIDRGERHLAYYTLVDGKGNIIKQDTFNIIGNDRMKTNYHDKLAAIEKDRDSARKDWKKINNIKEM KEGYLSQVVHEIAKLVIEHNAIVVFEDLNFGFKRGRFKVEKQVYQKLEKMLIEKLNYLVFKDNEFDKTGG VLRAYQLTAPFETFKKMGKQTGIIYYVPAGFTSKICPVTGFVNQLYPKYESVSKSQEFFSKFDKICYNLD KGYFEFSFDYKNFGDKAAKGKWTIASFGSRLINFRNSDKNHNWDTREVPTKELEKLLKDYSIEYGHGEC IKAAICGESDKKFFAKLTSVLNTILQMRNSKTGTELDYLISPVADVNGNFFDSRQAPKNMPQDADANGAY HIGLKGLMLLDRIKNNQEGKKLNLVIKNEEYFEFVQNRNN |
| SEQ ID NO: 110 | MDKKYSIGLDIGTNSVGWAVITDEYKVPSKKFKVLGNTDRHSIKKNLIGALLFDSGETAEATRLKRTARRRY TRRKNRICYLQEIFSNEMAKVDDSFFHRLEESFLVEEDKKHERHPIFGNIVDEVAYHEKYPTIYHLRKKLVDST DKADLRLIYLALAHMIKFRGHFLIEGDLNPDNSDVDKLFIQLVQTYNQLFEENPINASGVDAKAILSARLSKSR RLENLIAQLPGEKKNGLFGNLIALSLGLTPNFKSNFDLAEDAKLQLSKDTYDDDLDNLLAQIGDQYADLFLA AKNLSDAILLSDILRVNTEITKAPLSASMIKRYDEHHQDLTLLKALVRQQLPEKYKEIFFDQSKNGYAGYIDG GASQEEFYKFIKPILEKMDGTEELLVKLNREDLLRKQRTFDNGSIPHQIHLGELHAILRRQEDFYPFLKDNREK IEKILTFRIPYYVGPLARGNSRFAWMTRKSEETITPWNFEEVVDKGASAQSFIERMTNFDKNLPNEKVLPKHSL LYEYFTVYNELTKVKYVTEGMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYAHLFDDKVMKQLKRRRYTG WGRLSRKLINGIRDKQSGKTILDFLKSDGFANRNFMQLIHDDSLTFKEDIQKAQVSGQGDSLHEHIANLAGSP AIKKGILQTVKVVDELVKVMGRHKPENIVIEMARENQTTQKGQKNSRERMKRIEEGIKELGSQILKEHPVENT QLQNEKLYLYYLQNGRDMYVDQELDINRLSDYDVDHIVPQSFLKDDSIDNKVLTRSDKNRGKSDNVPSEEV VKKMKNYWRQLLNAKLITQRKFDNLTKAERGGLSELDKAGFIKRQLVETRQITKHVAQILDSRMNTKYDEN DKLIREVKVITLKSKLVSDFRKDFQFYKVREINNYHHAHDAYLNAVVGTALIKKYPKLESEFVYGDYKVYDV RKMIAKSEQEIGKATAKYFFYSNIMNFFKTEITLANGEIRKRPLIETNGETGEIVWDKGRDFATVRKVLSMPQ VNIVKKTEVQTGGFSKESILPKRNSDKLIARKKDWDPKKYGGFDSPTVAYSVLVVAKVEKGKSKKLKSVKEL LGITIMERSSFEKNPIDFLEAKGYKEVKKDLIIKLPKYSLFELENGRKRMLASAGELQKGNELALPSKYVNFLY LASHYEKLKGSPEDNEQKQLFVEQHKHYLDEIIEQISEFSKRVILADANLDKVLSAYNKHRDKPIREQAENIIH LFTLTNLGAPAAFKYFDTTIDRKRYTSTKEVLDATLIHQSITGLYETRIDLSQLGGD |
| SEQ ID NO: 111 | PKKKRKV |
| SEQ ID NO: 112 | KRPAATKKAGQAKKKK |
| SEQ ID NO: 113 | PAAKRVKLD |
| SEQ ID NO: 114 | RQRRNELKRSP |
| SEQ ID NO: 115 | NQSSNFGPMKGGNFGGRSSGPYGGGGQYFAKPRNQGGY |
| SEQ ID NO: 116 | RMRIZFKNKGKDTAELRRRRVEVSVELRKAKKDEQILKRRNV |
| SEQ ID NO: 117 | VSRKRPRP |
| SEQ ID NO: 118 | PPKKARED |

TABLE 5-continued

| SEQ ID NO | Sequence |
|---|---|
| SEQ ID NO: 119 | PQPKKKPL |
| SEQ ID NO: 120 | SALIKKKKKMAP |
| SEQ ID NO: 121 | DRLRR |
| SEQ ID NO: 122 | PKQKKRK |
| SEQ ID NO: 123 | RKLKKKIKKL |
| SEQ ID NO: 124 | REKKKFLKRR |
| SEQ ID NO: 125 | KRKGDEVDGVDEVAKKKSKK |
| SEQ ID NO: 126 | RKCLQAGMNLEARKTKK |
| SEQ ID NO: 127 | ATGGGTAAGATGTATTATCTGGGTTTGGATATAGGCACTAACTCTGTGGGATATGCAGTAACTGATCCCT CGTATCACTTGTTAAAGTTCAAAGGCGAACCCATGTGGGGAGCACATGTATTTGCTGCGGGTAATCAGA GTGCCGAAAGGCGATCTTTCAGAACATCCAGGAGGCGATTAGATAGGAGACAGCAAAGAGTAAAGCTT GTGCAAGAGATCTTTGCTCCTGTCATTTCACCTATAGACCCTCGTTTTTTTATAAGATTGCACGAATCGGC TCTATGGAGAGACGATGTTGCCGAAACAGATAAACATATCTTTTTCAATGATCCCACTTATACAGACAA GGAATACTACTCCGACTACCCGACAATTCATCATTTGATCGTCGATCTTATGGAGAGCTCTGAAAAGCAT GACCCCCGACTTGTCTATTTGGCTGTAGCTTGGTTAGTTGCTCATAGAGGTCATTTCTTGAATGAAGTAG ATAAAGACAATATAGGTGATGTACTTTCTTTTGATGCTTTCTACCCGGAATTTTTGGCCTTTTTGTCAGAC AATGGCGTCAGTCCCTGGGTCTGTGAGTCGAAGGCCCTTCAAGCTACTCTGCTGTCTAGGAATAGCGTCA ACGACAAATATAAAGCATTAAAATCGCTGATATTCGGATCGCAAAAACCGGAAGATAACTTTGACGCTA ACATCTCTGAAGATGGTTTAATCCAATTGCTGGCGGGTAAGAAAGTTAAAGTAAACAAACTATTCCCAC AAGAGTCCAACGATGCTAGCTTTACGTTGAATGATAAAGAAGACGCTATTGAAGAAATTCTAGGTACTT TAACGCCTGACGAGTGCGAATGGATCGCTCATATTCGCGATTGTTCGATTGGGCCATCATGAAACACG CGCTAAAGGATGGCAGGACGATATCTGAATCAAAAGTGAAGCTATACGAGCAGCATCATCATGACTTGA CTCAGTTAAAGTACTTTGTGAAGACCTACCTAGCTAAAGAGTATGATGATATCTTCAGAAACGTAGACTC CGAGACAACTAAAAATTATGTAGCTTATTCTTACCATGTGAAGGAAGTGAAAGGCACATTACCAAAAAA TAAAGCAACGCAAGAAGAATTTTGTAAATACGTCCTTGGCAAAGTCAAAAACATTGAATGTTCCGAAGC AGACAAGGTTGATTTTGATGAAATGATACAACGACTTACGGACAATTCTTTTATGCCAAAGCAAGTCTC AGGTGAAAATAGAGTAATACCATACCAGTTGTACTACTATGAATTAAAGACAATTTTAAACAAAGCCGC CTCATATCTACCTTTTTTGACACAATGCGGTAAAGATGCTATTTCTAACCAAGACAAATTACTGTCTATA ATGACATTTCGCATACCATATTTCGTCGGCCCTTTAAGGAAAGATAATTCAGAACATGCCTGGTTGGAAC GTAAAGCGGGTAAATTTACCCGTGGAACTTTAATGATAAAGTAGATCTTGATAAATCGGAGGAAGCCT TTATCCGTAGGATGACCAATACTTGCACGTATTACCCAGGAGAAGACGTGTTACCATTAGATTCACTTAT CTATGAAAGTTTATGATCTTGAATGAGATAAACAATATTAGGATTGACGGATACCCCATTTCTGTTGAT GTGAAACAACAAGTATTTGGTTTATTTGAGAAGAAAAGGCGAGTAACAGTTAAGGATATTCAAAATCTA CTATTATCTCTTGGAGCGTTGGATAAACACGGTAAGCTGACTGGTATTGACACGACAATACACTCTAATT ATAACACTTATCATCATTTTAAATCTCTTATGGAGCGGGGAGTATTGACCAGAGATGATGTGGAAAGAA TAGTGGAAAGAATGACATATTCTGACGATACTAAGAGGGTCAGACTGTGGTTAAATAATAATTATGGAA CTCTAACAGCTGACGATGTTAAGCATATCTCAAGACTCAGAAAACGATTTCGGCCGTTTGTCTAAAAT GTTTTTGACAGGATTGAAAGGTGTTCATAAGGAGACAGGCGAGAGAGCAAGTATACTTGGATTTTATGTG GAATACTAACGACAATTTAATGCAACTACTGTCCGAATGTTACACATTCTCGGATGAGATCACCAAATTA CAAGAGGCCTACTACGCAAAAGCTCAATTATCGCTAAATGACTTCTTGGACTCTATGTATATATCAAACG CCGTTAAGAGACCTATTTATCGGACCTTAGCGGTAGTAAATGATATTAGAAAGGCATGCGGGACGGCAC CTAAAAGAATTTTCATCGAGATGGCGCGAGATGGAGAGTCTAAGAAGAAAGATCTGTGACTCGTAGA GAGCAAATTAAAAATCTCTATAGATCAATTCGTAAAGACTTTCAACAAGAAGTTGATTTTCTGGAAAAG |

TABLE 5-continued

| SEQ ID NO | Sequence |
|---|---|
| | ATATTGGAAAATAAGAGTGACGGGCAGCTTCAGTCTGACGCTTTATATTTGTATTTTGCTCAATTAGGCA<br>GAGACATGTACACAGGTGATCCAATCAAATTAGAACATATTAAAGACCAATCTTTTTACAACATTGATC<br>ATATTTATCCTCAATCGATGGTGAAAGATGACAGTTTGGATAACAAGGTACTAGTCCAAAGCGAAATCA<br>ATGGCGAAAAGAGTTCGCGCTATCCATTAGACGCAGCCATTAGAAACAAAATGAAGCCGTTGTGGGATG<br>CCTACTATAATCATGGATTAATTTCTCTTAAGAAATACCAGCGTTTGACGAGATCTACTCCATTTACGGA<br>CGACGAGAAGTGGGATTTATCAATCGTCAGCTAGTTGAAACTAGGCAATCTACTAAAGCTTTAGCAAT<br>ATTGTTAAAGCGTAAGTTTCCAGATACTGAAATAGTTTACTCAAAGGCTGGACTATCCAGCGATTTTAGA<br>CATGAATTCGGCCTGGTTAAGAGTAGGAATATTAATGATCTACACCATGCTAAAGATGCCTTTCTCGCAA<br>TAGTTACTGGGAACGTTTATCATGAAAGATTTAATAGAAGATGGTTTATGGTTAACCAGCCATACTCTGT<br>GAAAACTAAGACATTGTTTACCCATTCAATTAAGAATGGCAACTTTGTCGCTTGGAATGGAGAAGAAGA<br>TCTTGGACGTATCGTAAAGATGTTGAAACAAACAAGAACACAATCCACTTCACCAGGTTTTCCTTTGAT<br>AGGAAGGAGGGATTGTTCGATATTCAACCTCTCAAAGCTTCTACCGGATTGGTTCCACGAAAAGCAGGG<br>TTGGATGTTGTTAAATATGGAGGATACGATAAAAGCACTGCCGCTGTATTATTTATTAGTACGTTTTACAC<br>TCGAGGATAAGAAGACTCAACACAAATTGATGATGATTCCTGTTGAAGGTCTCTACAAAGCACGTATTG<br>ACCATGATAAAGAGTTTTTAACAGATTATGCTCAGACCACGATCAGCGAAATTCTTCAAAAGGACAAGC<br>AGAAAGTGATCAACATCATGTTCCCTATGGGCACGAGACATATCAAACTGAATTCGATGATTTCTATTGA<br>TGGATTCTATCTTTCTATTGGTGGGAAGAGTAGCAAAGGTAAGTCGTACTATGTCATGCTATGGTGCCA<br>TTAATCGTCCCACACAAGATAGAATGTTATATCAAGGCTATGGAATCGTTTGCAAGAAAATTCAAAGAA<br>AATAATAAATTGAGGATCGTTGAAAAGTTTGATAAAATAACTGTTGAAGATAACTTGAACTTATACGAG<br>CTTTTTCTACAAAAGTTGCAACATAACCCATATAATAAATTTTTCTCTACACAATTTGATGTGTTGACGA<br>ACGGTAGAAGTACATTCACCAAATTGTCTCCAGAGGAGCAAGTCCAGACTTTACTTAATATACTGAGTA<br>TATTTAAAACTTGTCGTTCTTCTGGGTGTGATTTAAAATCAATAAATGGTTCCGCTCAAGCGGCTAGAAT<br>TATGGATATCCGCTGATTTAACTGGCTTATCAAAAAGTATTCAGATATTAGATTAGTTGAGCAAAGCGCA<br>TCAGGTCTATTTGTTTCAAAATCTCAAAATCTCTTGGAATACTTGCCAAAAAAGAAAAGGAAAGTTTAG |
| SEQ ID NO: 128 | ATGAGTAGTTTAACAAAGTTTACCAATAAATATAGTAAGCAACTAACTATAAAGAACGAATTGATACCG<br>GTCGGTAAGACTTTGGAAAACATAAAAGAAAATGGGTTGATTGATGGGACGAGCAATTGAATGAGAA<br>TTATCAAAAAGCAAAGATAATAGTAGATGATTTTTTGAGAGACTTTATTAATAAAGCTCTAAATAACACT<br>CAAATTGGTAACTGGAGAGAGCTAGCCGACGCCTTGAACAAGGAAGATGAGGATAATATTGAGAAATT<br>ACAAGATAAGATTAGAGGGATTATCGTGTCTAAGTTTGAGCTTTTGATCTGTTCAGTTCGTATTCGATT<br>AAAAAGGACGAGAAAATCATCGATGATGATAACGATGTGGAAGAAGAGGAGCTAGACCTTGGGAAGAA<br>GACATCTAGCTTCAAATACATATTCAAGAAAATTTGTTCAAACTTGTCCTTCCTTCATATTTAAAACA<br>ACAAATCAAGATAAGTTAAAAATCATTTCTTCCTTCGATAATTTTAGTACTTATTTTCGTGGTTTTTTCGA<br>AAACAGGAAAAATATATTCACTAAAAAGCCTATATCTACCTCTATAGCTTATAGAATTGTTCACGATAAT<br>TTCCCAAAATTTCTAGATAATATCAGGTGTTTTAATGTTTGGCAAACCGAGTGTCCTCAGTTAATAGTCA<br>AGGCCGACAACTACCTTAAAAGCAAGAATGTGATTGCAAAAGATAAGTCTTTGGCTAACTATTTTACAG<br>TCGGTGCCTATGATTATTTTCTGAGTCAAATGGTATCGATTTCTATAACAACATTATTGGCGGCTTACC<br>AGCTTTTGCCGGGCATGAGAAGATTCAGGGTTTGAACGAATTTATCAATCAAGAATGTCAAAAGGATTC<br>TGAATTAAAGTCTAAGCTCAAGAATAGGCACGCTTTCAAAATGGCAGTCTTATTCAAACAAATCCTTTCA<br>GACAGAGAAAAGTCATTTGTGATTGACGAGTTCGAATCAGACGCTCAGGTAATTGATGCTGTTAAAAAT<br>TTTTTACGCGGAACAATGCAAAGATAATAACGTCATATTTAATTTATTGAATCTGATCAAGAATATTGCTT<br>TTTTGTCGGATGATGAGTTAGACGGCATTTTCATAGAGGGTAAATACCTGTCCTCTGTGTCTCAAAAATT<br>GTATAGTGATTGGTCAAAGTTGAGAAATGATATTGAAGATTCGGCTAATTCTAAACAGGGTAACAAAGA<br>ATTAGCGAAGAAAATCAAAACTAACAAGGGTGATGTTGAAAAGGCTATAAGTAAGTACGAGTTCAGTTT<br>ATCTGAACTAAATTCAATTGTTCATGATAACACAAAATTTTCCGATCTTTTATCATGCACATTACATAAA<br>GTTGCAAGTGAAAAATTAGTCAAAGTAAACGAAGGTGATTGGCAAAGCATCTAAAAAACAACGAGGA<br>AAAACAGAAGATAAAAGAACCTCTTGACGCTTTATTGGAAATATACAATACTCTATTAATATTTAACTGT<br>AAAAGTTTTTAACAAAAATGGTAATTTCTATGTCGACTACGATCGCTGCATTAATGAGTTGTCCAGTGTTG<br>TGTACTTGTATAATAAAACTCGTAATTATTGTACGAAAAAGCCGTACAACACTGACAAATTTAAGTTGA<br>ATTTCAACTCCCCACAACTGGGTGAGGGCTTCTCTAAAAGTAAAGAGAATGATTGCCTTACATTATTATT<br>TAAAAAAGATGATAATTATTATGTCGGAATCATAAGAAAGGGGGCAAAGATCAACTTCGATGACACTCA<br>GGCCATAGCAGACAACACAGATAACTGTATATTCAAAATGAATTATTTTTTGCTGAAGGATGCTAAAAA<br>ATTTATCCCCAAATGTTCAATACAATTAAAAGAGGGTTAAGGCCCATTTCAAAAAGTCGGAAGATGACTA<br>TATTTTGTCCGATAAGGAAAAATTCGCTAGTCCGCTTGTTATTAAAAATCCACATTTCTTCTCGCTACG<br>GCTCATGTGAAAGGAAAGAAGGGCAATATTAAGAAATTTCAGAAAGAATACTCCAAAGAAAATCCTAC<br>GGAGTATAGAAATAGTCTGAACGAATGGATAGCATTCTGCAAAGAGTTCTTGAAGACCTATAAAGCTGC<br>CACCATCTTTGATATTACAACTTTGAAAAAGGCCGAGGAATACGCTGACATTGTGGAATTCTATAAGGA<br>TGTAGATAATCTTTGTTACAAGTTAGAATTTTGCCCTATCAAAACTTCTTTTATCGAAAATCTTATAGATA<br>ATGGCGATTTATACCTGTTTAGAATTAATAACAAGGACTTTTCTTCAAAAAGTACAGGCACGAAAAACTT<br>ACACACATTATACTTGCAGGCTATATTTGACGAGCGAAACTTAAACAACCCCACGATAATGTTGAATGG<br>AGGTGCAGAGTTATTCTACAGAAAAGAATCTATAGAACAGAAAATCGGATCACGCACAAAGCCGGTA<br>GTATCTTAGTGAATAAAGTGTGCAAAGATGGTACAAGTCTAGATGACAAATCCGTAACGAAATTTACC<br>AGTATGAAACAAATTCATTGATACTCTTTCGGACGAAGCTAAAAAGGTTCTGCCAAACGTTATTAAGA<br>AAGAGGCTACGCATGATATAACAAAAGATAAACGTTTCACTAGCGACAAATTCTTCTTTCATTGTCCTTT<br>AACAATCAACTACAAGGAAGGTGACACCAAACAATTTAATAATGAAGTGCTCTCATTCCTTAGAGGTAA<br>CCCCGATATCAATATTATCGGCATTGATAGAGGAGAAAGAAACCTAATCTATGTAACAGTCATTAACCA<br>AAAAGGCGAAATATTGGATAGCGTCTCCTTCAATACTGTCACCAATAAGTCATCGAAGATAGAACAAAC<br>TGTTGATTACGAAGAAAAATTGGCCGTTAGAGAAAAGGAACGTATCGAAGCGAAGAGATCTTGGGATA<br>GCATATCCAAGATTGCCACCTTGAAGGAGGGTTATCTAAGCGCGATCGTACATGAAATCTGCTTATTAAT<br>GATTAAGCATAATGCTATTGTCGTGTTAGAAAACCTGAATGCCGGTTTTAAAAGGATTAGAGGTGGTTTG<br>TCAGAAAGTCAGTATATCAAAAGTTTGAAAAGATGCTTATTAATAAACTCAACTACTTCGTTAGCAAAC<br>AAAGAAAGTGATTGGAATAAACCGTCAGGTTTGCTCAATGGTCTTCAGTTAAGTGATCAATTTGAGTCTT<br>TCGAAAAATTAGGAATTCAAAGTGGATTCATTTTTATGTACCAGCCGCGTACACTTCAAAAATTGACCC<br>TACGACCGGATTTGCCAACGTCTTGAATTTGTCCAAGGTCAGAAATGTTGACGCCATCAAAAGTTTTTTT<br>AGCAACTTCAATGAAATCTCTTATTCCAAAAAGGAAGCCCTTTTCAAGTTTTCTTTTGACCTAGACTCGTT<br>ATCGAAGAAAGGATTTTCATCTTTCGTAAAGTTTAGCAAGTCCAAGTGGAATGTATACACATTCGGCGA |

TABLE 5-continued

| SEQ ID NO | Sequence |
|---|---|
| | GAGAATTATCAAGCCCAAGAACAAACAGGGCTATAGAGAAGACAAGAGAATCAACTTGACTTTTGAGA<br>TGAAAAAATTACTCAACGAATACAAGGTTTCATTTGATTTGGAGAACAACTTGATTCCCAATTTGACATC<br>AGCTAACTTGAAGGATACGTTCTGGAAGGAGTTATTCTTTATATTCAAAACGACATTACAACTGCGTAAT<br>AGTGTTACAAACGGTAAAGAAGATGTATTAATCTCCACCTGTAAAGAATGCCAAAGGAGAATTTTTCGTA<br>TCCGGTACTCACAATAAGACACTACCACAGGATTGCGACGCTAACGGTGCGTATCATATTGCGTTGAAA<br>GGATTAATGATACTTGAAAGAAATAACCTTGTTCGCGAAGAAAAAGACACCAAGAAGATCATGGCTATT<br>AGCAATGTTGATTGGTTTGAATACGTGCAAAAGAGGAGAGGTGTTTTGTAA |
| SEQ ID NO: 129 | ATGAACAATTATGACGAGTTCACAAAGCTATACCCTATCCAAAAAACTATCAGGTTCGAATTGAAACCA<br>CAAGGGAGAACAATGGAACATCTGGAGACATTCAACTTTTTTGAAGAGGACAGAGACAGAGCGGAGAA<br>ATACAAAATTTTAAAAGAGGCCATCGATGAATATCACAAAAAGTTTATCGACGAGCATTTAACAAACAT<br>GTCTTTGGACTGGAATTCACTTAAACAAATTTCTGAGAAATATTATAAGTCTCGGGAGGAAAAAGACAA<br>AAAGGTCTTTTTGTCCGAGCAAAAGAGAATGAGACAAGAAATTTGTCTCGGAGTTTAAAAAAGATGATCG<br>GTTCAAAGATTTGTTTAGCAAGAAATTGTTTTCTGAATTGTTGAAGGAGGAGATATACAAGAAAGGCAA<br>CCATCAAGAATAGATGCTTTGAAATCGTTTGACAAGTTCAGCGGTTACTTCATTGGTTTACATGAAAAT<br>AGGAAGAACATGTATAGCGACGGCGATGAGATCACCGCTATATCGAATAGAATCGTTAACGAAAATTTT<br>CCGAAATTTTTGGATAATTTGCAAAAATACCAGGAAGCTAGGAAAAAGTACCCTGAATGGATAATAAAG<br>GCGGAATCAGCTTTGGTGGCTCACAACATAAAGATGGATGAAGTCTTCTCGCTGGAATATTTTAACAAA<br>GTATTAAATCAGGAAGGAATCCAAAGATACAACTTAGCCTTGGGTGGATACGTAACCAAATCAGGTGAG<br>AAAATGATGGGCTTAAATGATGCACTTAATCTAGCTCACCAATCCGAAAAGTCCTCTAAAGGGAGGATA<br>CACATGACACCATTGTTTAAGCAAATCCTTTCGGAGAAAGAATCTTTTTCATATATCCCCGATGTTTTCA<br>CTGAGGATAGTCAATTGTTGCCCAGCATTGGTGGATTTTTTGCACAAATAGAAAATGATAAAGATGGTA<br>ACATCTTCGATAGAGCCTTGGAATTGATAAGCTCCTATGCAGAATACGATACGGAACGAATATACATTA<br>GACAAGCTGACATCAACAGAGTAAGCAATGTTATTTTTGGTGAGTGGGGAACTTTAGGTGGATTAATGC<br>GGGAGTACAAAGCTGACTCAATCAATGATATTAATTTGGAACGTGCGTCAAAAAAGTCGATAAGTGGC<br>TTGATAGTAAGGAGTTTGCTCTGTCGGATGTACTAGAAGCAATTAAGAGAACAGGAAACAATGATGCAT<br>TTAATGAATATATTAGTAAAATGAGGACGGCTAGAGAAAAGATAGACGCCGCACGTAAGGAAATGAAG<br>TTTATTTCCGAGAAAATATCTGGCGATGAAGAGTCGATTCACATCATCAAGACCCTACTCGATTCTGTTC<br>AGCAATTTCTCCATTTTTTTAACCTCTTCAAAGCAAGACAAGACATTCCCTTAGATGGGGCTTTTTATGCC<br>GAATTTGATGAAGTTCATTCAAAGTTGTTTGCTATTGTTCCTCTTTACAATAAGGTCCGTAATTACCTTAC<br>TAAAAATAACTTGAACACCAAGAAAATAAAGTTAAACTTCAAGAATCCGACTCTTGCCAACGGGTGGGA<br>TCAGAATAAAGTTTATGATTATGCTAGCTTAATATTTCTAAGAGATGGGAATTATTACTTAGGAATCATC<br>AATCCAAAGCGTAAGAAAAACATTAAATTTGAACAAGGGTCAGGCAATGGCCCATTCTATAGAAAAAT<br>GGTGTATAAGCAAATACCAGGACCTAACAAGAACTTGCCTCGCGTATTTTTAACTTCAACAAAGGGTAA<br>AAAAGAATATAAACCAAGCAAAGAAATTATTGAAGGTTACGAAGCAGATAAACACATCAGAGGTGATA<br>AGTTCGATCTGGATTTCTGCCATAAATTGATTGACTTTTTTAAGGAATCTATAGAAAAACATAAGGACTG<br>GTCCAAATTTAATTTCTACTTCTCACCTACAGAAAGTTATGGTGACATTTCAGAATTTTATTTAGACGTTG<br>AGAAACAAGGATATAGGATGCATTTTGAAAATATTTCAGCGGAACATCGACGAATACGTTGAGAAG<br>GGTGATTTATTCTTGTTCCAAATTTACAATAAAGACTTCGTTAAAGCTGCAACCGGAAAGAAGGATATGC<br>ATACCATATATTGGAACGCTGCATTCTCGCCAGAAAACTTACAAGATGTCGTTGTAAAGCTTAATGGAG<br>AAGCTGAGCTGTTCTATAGAGACAAGAGTGATATAAAAGAGATTGTGCATCGGGAAGGTGAAATTCTGG<br>TGAACAGAACTTACAATGGTCTACACCCGTTCCAGACAAAATACATAAAAAACTGACCGATTATCATA<br>ATGGTAGGACAAAGGACTTGGGCGAGGCCAAGGAGTACCTCGATAAAGTTAGATATTTCAAGGCACACT<br>ATGATATTACGAAAGACAGGAGATATTTAAACGATAAAATTTACTTTCATGTCCCTTTGACCCTTAACTT<br>TAAAGCTAATGGTAAAAGAATTTGAACAAAATGGTAATTGAGAAGTTTTTATCGGACGAAAAAGCTCA<br>CATAATCGGAATCGACCGCGGAGAGAGAAATTTACTGTATTATAGTATCATCGACAGAAGTGGAAAGAT<br>TATTGATCAGCAATCTTTGAACGTCATTGATGGGTTTGACTATCGGGAAAAGTTAAATCAAAGGGAAAT<br>TGAAATGAAGGATGCGAGACAATCATGGAATGCCATTGGTAAAATTAAAGATCTCAAGGAGGGGTACTT<br>ATCAAAAGCTGTACACGAGATAACTAAAATGGCTATCCAATATAATGCAATTGTTGTAATGGAAGAATT<br>GAATTATGGTTTTAAACGCGGCAGGTTTAAAGTCGAAAAACAAATATACCAAAAGTTTGAAAACATGTT<br>AATTGATAAGATGAACTATCTTGTTTTCAAAGATGCACCTGATGAGAGTCCTGGCCGGTGTGCTGAACGCC<br>TATCAATTAACAAACCCATTAGAGTCCTTTGCTAAACTGGGTAAACAAACTGGCATTCTATTTTATGTTC<br>CAGCCGCTTACACCTCAAAGATCGATCCAACGACCGGTTTTGTAAACTTATTTAATACTTCTTCCAAAAC<br>AAACGCGCAAGAACGCAAAGAATTCCTACAAAAATTTGAATCAATATCCTATAGCGCAAAAGATGGAG<br>GTATATTCGCTTTCGCTTTTGACTACAGAAAGTTTGGCACTTCCAAGACAGATCATAAAAATGTGTGGAC<br>CGCTTATACCAACGGAGAAAGGATGCGTTATATTAAGAAAAAAAGAGGAACGAACTATTTGATCCATC<br>GAAAGAAATTAAAGAAGCTTTGACAAGCAGCGGAATCAAATATGATGGAGGTCAAAACATACTTCCAG<br>ATATTCTCAGATCTAATAATAACGGTCTTATTTACACGATGTATTCATCTTTTATCGCTGCCATCCAAATG<br>CGTGTGTATGATGGCAAGGAAGATTATATTATATCTCCTATTAAAAATTCAAAGGGTGAATTTTTTCGCA<br>CGGATCCAAAAAGAAGAGAGCTTCCAATTGACGCCGATGCTAACGGTGCTTACAATATTGCATTGCGTG<br>GTGAACTTACTATGAGAGCCATCGCCGAAAAGTTTGATCCGGACAGTGAAAAAATGGCGAAATTGGAGC<br>TAAAGCACAAGGATTGGTTTGAATTCATGCAGACCCGTGGCGATTGA |
| SEQ ID NO: 130 | ATGACTAAAACGTTCGACTCCAGTTTTTTAATCTCTATTCCTTGCAAAAGACCGTTAGGTTTGAATTGA<br>AACCAGTTGGTGAAACTGCCTCATTTGTCGAAGACTTTAAAAACGAGGGATTGAAAAGAGTGGTTAGTG<br>AAGATGAAAGAAGGGCAGTAGACTATCAAAAGGTTAAAGAAATCATTGACGATTACCACAGAGATTTT<br>ATAGAAGAATCTCTGAACTATTTTCCAGAGCAGGTTTCAAAAGATGCTCTAGAGCAAGCGTTTCATTTGT<br>ATCAAAAGTTGAAAGCAGCGAAGGTGGAAGAAAGGGAAAAAGCTTTAAAAGAATGGGAAGCATTACA<br>GAAAAAATTGCGAGAAAAAGTCGTCAAATGTTTCAGCGACTCTAATAAAGCTCGCTTTTCTAGAATCGA<br>TAAAAAAGAATTGATTAAGGAAGATTTAATAAATTGGCTGGTAGCACAAAAACAGAGAGGATGATATTCC<br>TACTGTTGAAACGTTCAATAATTTTACTACTTACTTCACTGGTTTCATGAGAACGGAGAAGAATATTTAC<br>TCTAAAGATGATCACGCTACTGCTATAAGTTTTAGGTTGATTCACGAAAACTTGCCTAAATTTTTGACA<br>ATGTCATCAGTTTTAACAAGTTGAAAGAAGGTTTCCCGGAATTAAAATTCGACAAAGTTAAGAAGATT<br>TAGAAGTAGATTACGACTTGAAGCATGCGTTTGAAATTGAATATTTCGTTAATTTCGTCACACAAGCTGG<br>TATCGACCAATATAATTACCTGCTTGGAGGCAAAACTCTAGAAGACGGTACGAAGAACAAGGAATGA<br>ATGAACAGATTAATTTATTTAAGCAACAACAAACTCGCGATAAAGCTAGACAGATTCCAAAACTGATTC |

| SEQ ID NO | Sequence |
|---|---|
| | CACTTTTCAAACAGATTCTATCTGAGAGAACTGAATCTCAGAGTTTTATCCCTAAGCAGTTCGAGTCTGA<br>TCAGGAACTATTCGATTCCCTGCAGAAATTGCATAACAACTGTCAAGATAAGTTTACCGTTTTGCAACAG<br>GCGATCTTGGGATTGGCTGAGGCAGATCTTAAAAAGGTCTTTATTAAAACTAGTGATCTAAACGCATTGT<br>CTAACACTATTTTTGGAAATTATTCTGTGTTCTCAGACGCGCTCAATTTATATAAAGAGTCGCTAAAAAC<br>TAAAAAGGCTCAAGAAGCTTTTGAAAAGTTGCCTGCACATAGTATTCATGATTTAATCCAATACTTAGAA<br>CAATTTAATTCGTCTCTCGATGCTGAAAAGCAACAGTCTACCGATACTGTATTAAACTACTTTATTAAAA<br>CCGACGAATTATATAGTCGTTTCATTAAATCCACCTCTGAGGCATTCACCCAAGTACAACCTCTCTTTGA<br>ACTGGAAGCTTTGAGCTCCAAAAGAAGACCCCCAGAAAGTGAAGATGAGGGGGCTAAAGGCCAAGAAG<br>GTTTCGAACAAATTAAGAGAATCAAAGCTTATCTAGACACTCTAATGGAGGCTGTCCACTTTGCTAAGCC<br>TTTGTATCTTGTCAAGGGTAGAAAGATGATAGAGGGTCTAGACAAGGATCAAAGCTTCTACGAAGCGTT<br>TGAAATGGCCTACCAGGAGTTGGAGTCTTTAATCATCCCCATTTACAATAAGGCCAGATCTTACCTGTCT<br>AGGAAGCCATTTAAAGCGGATAAATTCAAATTAATTTTGACAATAATACACTTCTATCTGGGTGGGAT<br>GCTAACAAGGAGACGGCTAACGCCAGCATATTGTTTAAGAAGGATGGTTTATACTACCTGGGAATCATG<br>CCAAAAGGCAAAACTTTCTTGTTCGATTATTTCGTTAGTTCAGAAGATTCTGAAAAGTTGAAACAACGGA<br>GACAGAAAACCGCAGAGGAAGCGCTCGCACAGGATGGAGAATCCTATTTTGAAAAAATACGGTATAAA<br>CTCCTACCAGGTGCTAGTAAGATGTTGCCAAAGGTATTTTTAGCAATAAAAATATTGGGTTTTACAATC<br>CCTCAGATGATATTCTACGAATTCGGAATACGGCCTCTCATCTAAGAATGGTACTCCCCAGAAGGGTC<br>ATTCCAAGGTAGAATTTAACTTGAATGACTGTCACAAAATGATTGATTTTTTAAATCTTCCATACAGAA<br>ACATCCCGAGTGGGGATCCTTTGGTTTCACTTTTTCTGATACGTCGGACTTTGAAGATATGAGTGCTTTCT<br>ACCGAGAAGTTGAAATCAAGGTTACGTTATAAGTTTTGATAAAATAAAAGAAACTTACATTCAGTCTC<br>AAGTTGAGCAAGGTAACTTATATTTATTTCAAATTTACAACAAAGATTTTAGTCCGTATTCAAAGGGAAA<br>GCCAAACCTGCACACTTTATACTGGAAAGCTCTGTTTGAAGAGGCTAATTTGAATAACGTAGTGGCTAA<br>GCTAAACGGCGAAGCAGAAATCTTTTTCAGAAGACACAGTATCAAAGCATCTGATAAAGTGGTACATCC<br>TGCTAATCAAGCTATAGATAATAAGAATCCCCATACTGAGAAGACGCAGTCCACATTTGAATATGACTT<br>GGTCAAGACAAAAGATATACCCAAGACAAATTTTTTTTCATGTACCGATATCTTTAAACTTTAAGGCT<br>CAGGGCGTTTCAAAGTTTAATGATAAGGTAAATGGATTCTTAAAGGGCAATCCCGACGTTAATATAATC<br>GGTATAGATCGAGGTGAGAGACATCTTTTATACTTTACCGTGGTGAATCAAAAAGGAGAAATATTAGTG<br>CAAGAGTCCTTGAATACATTAATGTCTGACAAGGGTCATGTCAACGATTATCAACAGAAATTGGACAAG<br>AAGGAACAGGAAAGGGACGCTGCCAGGAAGTCCTGGACGACAGTAGAAAATATTAAAGAATTAAAAGA<br>AGGTTATTTATCACATGTGGTTCATAAACTTGCACATTTAATCATCAAATATAACGCAATAGTGTGCTTG<br>GAAGATCTTAATTTTGGCTTCAAGAGGGGTAGGTTCAAGGTCGAAAAACAGGTCTACCAGAAGTTCGAG<br>AAAGCTCTGATCGATAAATTGAATTATCTTGTTTTCAAAGAAAAAGAATTAGGAGAAGTTGGTCATTATC<br>TTACAGCATACCAACTCACTGCACCATTTGAAAGCTTCAAAAAGCTAGGCAAGCAATCTGGGATTTTGTT<br>CTATGTTCCGGCTGATTATACATCAAAGATAGATCCTACCACAGGCTTTGTAAATTTTTAGATCTTAGG<br>TACCAATCCGTTGAAAAAGCTAAACAGTTGCTGTCCGATTTTAATGCGATAAGATTTAATAGTGTTCAGA<br>ATTATTTTGAGTTCGAAATTGATTATAAAAAATTGACACCAAAACGTAAAGTAGGAACACAATCTAAAT<br>GGGTTATTTGTACCTATGGAGATGTTAGATACCAAAACAGAAGAAATCAGAAAGGTCACTGGGAAACTG<br>AAGAAGTTAACGTTACTGAAAAACTTAAAGCTCTATTTGCGAGCGATTCAAAAACGACGACGGTGATCG<br>ATTATGCAAATGATGATAACCTTATTGATGTAATTCTGGAACAAGATAAGGCATCATTTTTTAAAGAACT<br>ACTATGGTTGTTAAAGCTAACCATGACCCTAAGGCACTCCAAGATAAAGTCAGAGGATGATTTATCCTC<br>TCTCCAGTGAAAAACGAACAAGGTGAGTTTTACGACTCAAGAAAGGCGGGTGAAGTCTGGCCTAAGGAT<br>GCTGATGCCAATGAGCTTATCACATCGCTCTGAAGGGGCTATGGAACTTACAGCAAATTAACCAATGG<br>GAAAAAGGTAAAACTTTAAACCTCGCCATAAAGAACCAGGATTGGTTCAGCTTTATCCAAGAAAAACCA<br>TATCAAGAATAA |
| SEQ ID NO: 131 | ATGCACACAGGAGGTCTACTCTCGATGGATGCTAAGGAATTTACCGGTCAATATCCGCTGTCCAAAACTT<br>TGCGTTTTGAGCTTAGACCTATTGGCCGAACGTGGGATAACCTAGAGGCTTCTGGTTATTTGGCGGAAGA<br>TAGACATAGAGCTGAGTGTTATCCCCGAGCTAAAGAATTGCTGATGATAACCACAGGGCGTTCCTGAA<br>TAGAGTTCTACCGCAAATCGATATGGATTGGCATCCAATTGCTGAAGCTTTCTGCAAGGTGCACAAAAA<br>TCCAGGTAATAAAGAATTGGCTCAGGATTATAATTTGCAGCTTAGGTAAGAGAAGAAAAGAAATTTCCGC<br>TTATTTGCAGGATGCTGATGGATACAAGGGGTTGTTCGCGAAACCTGCCCTGGACGAAGCTATGAAAAT<br>AGCTAAGGAAAACGGCAATGAATCTGATATTGAAGTTTTGGAAGCCTTCAATGGATTTTCCGTTTATTTC<br>ACTGGTTATCATGAGAGTAGGGAGAATATATACTCAGACGAAGATATGGTATCCGTCGCCTATCGCATA<br>ACTGAAGATAATTTTCCAAGGTTCGTGTCGAACGCGTTAATTTTTGATAAACTTAATGAATCGCACCCGG<br>ATATTATTTCGGAAGTGTCCGGTAATCTGGGGGTAGACGATATTGGTAAATATTTTGATGTGTCCAACTA<br>CAATAATTTCCTTAGTCAAGCAGGAATTGATGACTACAACCATATTATAGGAGGGCATACAACTGAAGA<br>CGGTCTCATTCAAGCTTTTAACGTAGTGTTAAACCTAAGGCACCAAAAAGACCCAGGTTTTGAGAAAAT<br>TCAATTTAAGCAACTCTACAAGCAGATACTGAGCGTTAGGACTAGTAGGTCATATATCCCAAAGCAATT<br>CGATAACTCAAAGGAAATGGTCGACTGTATATGCGACTACGTCTCAAAAATAGAAAAATCTGAAACAGT<br>AGAAAGAGCTCTGAAATTGGTAAGAAATATATCTTCTTTTGATTAAGAGGTATTTTCGTAAATAAAAAA<br>AACCTTCGAATTTTGTCTAATAAGTTAATTGGAGACTGGGACGAATAGAGACAGCTTTGATGCACAGTT<br>CCAGCAGTGAAAACGATAAGAAATCAGTGTATGACTCTGCAGAGGCATTCACCCTTGATGATATCTTCA<br>GTTCTGTGAAAAAGTTCAGCGACGCCTCGCTGAGGATATGGAGAGACATATGTCGTG<br>TTATCTCAGAAACAGCTCCTTTCATTAACGACTTAAGGGCTGTAGATTTGGATTCTTTAAATGATGACGG<br>CTATGAAGCGGCCGTGTCTAAAATACGGGAATCTTGAACCCTACATGGATCTATTTCACGAATTGGAG<br>ATCTTTAGCGTGGGTGATGAGTTTCCTAAATGTGCTGCCTTTTATAGCGAGTTGGAAGAGGTCTCAGAAC<br>AACTGATTGAAATCATTCCTTTATTTAACAAAGCAAGAAGTTTTTGCACAAGAAAGGTATTCAACCG<br>ACAAAATCAAAGTCAATTTAAAATTCCCTACTCTGGCAGATGGATGGGATCTAAATAAAGAAAGGGATA<br>ACAAAGCCGCAATTCTAAGAAAGACGGTAAATACTACCTGGCAATTTTAGACATGAAGAAGATCTCA<br>GTAGTATTCGTACGAGCGATGAGGACGAGTCTTCTTTTGAAAAGATGGAATATAAATTGCTCCCTTCTCC<br>TGTGAAAATGCTTCCAAAAATTTTTGTTAAATCGAAAGCCGCCAAAGAAAAGTACGGGTTGACCGATAG<br>AATGTTAGAATGCTACGATAAAGGTATGCATAAGTCGGGTAGTGCTTTTGATTTGGGTTTTGTCATGAA<br>TTGATCGATTACTATAAGCGCTGCATTGCCGAGTACCCAGGCTGGGATGTTTCGACTTTAAATTTCGTG<br>AGACAAGCGATTACGGATCCATGAAAGAATTTAATGAAGACGTCGCTGGCGCAGGTTACTATATGTCAC<br>TTAGAAAGATTCCATGTTCCGAAGTTTATCGTTTACTGGACGAGAAGTCAATTTACTTGTTTCAAATATA<br>TAATAAGGATTATAGCGAAAACGCACATGGGAATAAGAATATGCATACGATGTATTGGGAGGGCTTGTT |

TABLE 5-continued

| SEQ ID NO | Sequence |
|---|---|
| | CTCACCACAAAATTTGGAATCACCAGTCTTCAAATTGTCCGGAGGCGCAGAACTTTTTTTCAGAAAGTCA<br>TCTATTCCTAATGACGCTAAAACGGTACATCCGAAAGGTTCAGTTCTTGTTCCCAGAAACGACGTCAATG<br>GTAGAAGAATACCAGACTCGATCTACAGAGAGTTGACAAGGTATTTTAACCGTGGGGATTGCAGGATCA<br>GTGATGAAGCTAAGTCTTACCTGACAAGGTCAAGACAAAAAAGCGGACCATGACATTGTTAAGGAT<br>AGAAGATTTACTGTAGATAAGATGATGTTCCATGTTCCGATTGCCATGAATTTTAAAGCTATAAGTAAAC<br>CAAATCTTAATAAGAAAGTTATTGATGGCATAATAGATGATCAAGATTTGAAAATCATCGGTATCGATC<br>GTGGTGAGAGAAATCTTATTTATGTGACCATGGTCGATAGGAAGGGGAATATATTGTATCAAGACAGTC<br>TTAATATTTTAAATGGATACGATTACCGCAAAGCTTTAGACGTGAGGGAATATGATAACAAAGAAGCTA<br>GAAGGAATTGGACTAAAGTAGAAGGTATTAGAAAAATGAAAGAAGGTTATTTATCTTTAGCTGTTAGTA<br>AATTGGCCGATATGATCATCGAAAATAATGCTATAATCGTAATGGAAGATTTGAATCACGGGTTTAAGG<br>CAGGTCGTTCCAAAATTGAAAAGCAGGTGTATCAAAAATTCGAATCAATGTTAATCAACAAGTTAGGAT<br>ACATGGTGCTAAAAGACAAGTCCATTGACCAGTCTGGTGGAGCCCTTCATGGTTACCAATTAGCCAATC<br>ATGTTACGACCTTAGCTAGCGTGGGTAAACAATGTGGAGTAATTTTTTACATACCTGCAGCTTTTACTTC<br>GAAGATTGATCCCACCACGGGCTTTGCTGATTTATTCGCTCTCTCTAATGTGAAGAATGTCGCTTCTATG<br>AGAGAGTTCTTCTCCAAAATGAAGTCAGTAATATATGACAAGGCGGAAGGCAAATTCGCCTTTACATTT<br>GATTATTTGGATTATAACGTTAAAAGCGAATGTGGACGTACCTTATGGACTGTGTATACAGTTGGTGAAC<br>GCTTCACCTACTCTAGAGTAAACCGAGAGTATGTTCGGAAAGTCCAACAGATATCATCTATGATGCATT<br>ACAAAAAGCTGGTATTAGCGTCGAAGGTGACCTTAGAGATAGAATCGCGGAAAGCGACGGTGACACAT<br>TAAAGTCTATATTCTACGCTTTTAAATACGCGTTGGATATGAGAGTCGAAAACAGAGAGGAAGACTATA<br>TACAGTCACCTGTGAAGAATGCTTCTGGTGAGTTCTTTTGTTCAAAAAACGCCGGAAAGTCTTTGCCGCA<br>GGATTCAGATGCAAATGGTGCCTATAATATAGCTCTGAAAGGGATCCTACAACTCAGAATGTTGAGCGA<br>ACAATACGATCCAAATGCAGAATCGATTAGATTGCCACTTATAACTAACAAGGCATGGTTAACTTTTATG<br>CAATCCGGTATGAAAACTTGGAAGAATTAA |
| SEQ ID NO: 132 | ATGGATTCTCTTAAGGATTTCACTAATTTATATCCAGTCTCGAAAACATTGCGGTTCGAATTGAAACCAG<br>TTGGGAAAACTCTAGAAAACATTGAAAAAGCCGGTATATTGAAAGAAGATGAACACAGAGCGGAATCC<br>TACCGCCGGGTAAAAAAGATAATTGACACATACCATAAAGTGTTTATTGACAGCTCCTTAGAGAACATG<br>GCTAAAATGGGGATAGAAAATGAAATCAAGGCTATGCTGCAGTCTTTTTGTGAACTCTATAAGAAAGAC<br>CACAGGACAGAAGGAGAAGATAAAGCTCTTGATAAAATTAGAGCTGTTCTTAGAGGTTTGAAGTCGTTGGG<br>GCTTTCACTGGTGTATGTGGAAGACGAGAAAACACAGTACAAAATGAAAAGTACGAGAGTTTGTTCAAA<br>GAAAAATTGATAAAGGAAATTTTGCCAGATTTCGTGTTGTCCACCGAGGCTGAGTCTCTTCCATTCAGCG<br>TTGAAGAAGCAACAAGGAGCTTAAAAGAGTTTGACTCATTCACTTCTTATTTTGCTGGTTTTTACGAAAA<br>TAGAAAGAATATATTTATTCCACGAAACCGCAAAGTACTGCGATAGCCTACAGATTAATTCATGAAACTT<br>GCCTAAATTTATAGATAATATTTTGGTCTTCCAGAAGATTAAAGAACCAATCGCTAAAGAACTTGAACA<br>CATAAGAGCAGATTTTAGCGCAGGCGGATATATCAAAAAAGATGAACGGCTAGAAGACATATTCTCATT<br>AAATTACTACATTCATGTCCTTTCTCAAGCTGGTATAGAAAATATAATGCTTAATCGGGAAGATAGTG<br>ACGGAAGGTGATGGTGAAATGAAAGGTCTTAATGAACATATTAACTTATATAACCAACAGAGGGGTCGA<br>GAGGATAGGTTGCCCTTGTTTAGGCCTCTATACAAGCAAATCCTGTCCGATAGAGAGCAATTGTCTTATT<br>TACCTGAATCATTTGAAAAAGATGAAGAGCTGCTTAGAGCACTTAAGGAATTTTACGATCACATCGCCG<br>AAGCACATCTTGGGTAGAACACAGCAATTGATGACTTCAATTTCTGAATACGACTTGTCCCGTATTTATGT<br>CAGAAATGATTCTCAACTTACAGACATCTCGAAGAAAATGCTAGGAGATTGGAACGCCATTTATATGGC<br>TAGAGAACGAGCCTACGACCACGACAGGCTCCTAAACGTATTACTGCTAAATACGAACGTGATAGAAT<br>CAAGGCCTTAAAAGGTGAAGAGTCAATTTCATTGGCGAATCTGAACAGCTGTATAGCTTTCTTGGACAA<br>TGTAAGGGATTGTCGAGTTGACACATACCTATCAACTTTGGGGCAGAAAGAGGGTCCTCATGGCTTAAG<br>TAACTTGGTGGAAAACGTCTTCGCCTCATATCATGAAGCAGAACAGTTATTGTCGTTTCCTTACCCCGAA<br>GAGAACAACCTTATTCAGGACAAAGACAATGTAGTTTTGATCAAAAACCTATTGGATAATATAAGTGAT<br>TTACAACGTTTCCTTAAACCCTTTGTGGGGAATGGGCGATGAACCTGACAAAGACGAAAGGTTTTACGGT<br>GAATACAACTATATTAGAGGAGCGCTTGACCAGGTAATACCTTTGTACAATAAAGTAAGGAACTACTTG<br>ACTCGTAAACCATATTCTACTAGAAAAGTTAAATTGAACTTTGGTAATTCACAGCTGCTGAGTGGTTGGG<br>ATCGTAATAAAGAAAAAGATAACTCCTGTGTTATCTTGCGAAAAGGACAAAACTTTTACTTGGCAATTA<br>TGAACAACCGTCACAAAAGGTCCTTCGAGAACAAAGTTCTGCCTGAATACAAAGAAGGTGAACCATATT<br>TTGAAAAAATGGACTATAAATTCCTGCCAGATCCTAATAAAATGTTGCCTAAGGTCTTCTTGTCTAAAAA<br>AGGTATAGAAATATATAAACCATCCCCGAAGTTGCTGGAGCAATATGGTCATGGAACGCACAAAAAAG<br>GTGACACTTTTAGTATGGATGACTTGCACGAGTTGATTGATTTTTTAAACATTCCATTGAAGCGCACGA<br>AGATTGGAAACAATTTGGTTTCAAGTTCTCTGACACAGCCACTTACGAAAATGTATCGTCCTTTTATAGA<br>GAAGTGGAAGATCAGGGTTATAAACTGTCATTCCGTAAGGTTAGTGAAAGCTATGTGTACTCGTTGATC<br>GATCAAGGGAAGCTTTATCTTTTCAAATCTATAATAAAGATTTCTCTCCTTGTTCAAAGGGCACACCTA<br>ATCTTCATACACTATACTGGGAGAATGCTTTTCGATGAAAGAAATTTGGCTGATGTGATCTATAAATTAGA<br>CGGTAAAGCTGAGATTTTTTTCAGAGAGAAATCCCTGAAAAACGACCATCCAACTCATCCGGCAGGTAA<br>ACCGATTAAAAGAAATCCCGGCAAAAAAGGGCGAAGAGAGTTTATTCGAGTATGATTTAGTTAAGG<br>ACAGACATTATACAATGGACAAATTTCAATTTCATGTGCCCATTACTATGAACTTTAAGTGTAGTGCAGG<br>GTCTAAGGTTAATGATATGGTAAACGCACATATTAGAGAAGCTAAAGATATGCACGTCATCGGTATTGA<br>TCGCGGAGAAAGAAATTTACTTTACATTTGCGTTATCGATTCTAAAAACAGTTAATAGATAAGTTGA<br>ATTATCTAGTGGATAAAAAAAAGCGTCCTGAGGACATTGGCGGTTTATTAAGAGCCTACCAATTCACTG<br>CGCCATTTAAATCGTTCAAAGAAATGGGTAAACAAAACGGTTTTCTATTCTACATCCCCGCATGGAATAC<br>CTCAAATATAGATCCAACTACCGGTTTCGTCAACTTATTTCATGCTCAATATGAGAATGTGGACAAAGCA<br>AAATCATTCTTTCAAAAATTTGATAGCATTAGCTACAATCCTAAAAAAGATTGGTTTGAATTTGCGTTCG<br>ATTATAAAATTTCACCAAGAAGGCTGAAGGTTCCAGATCTATGTGGATATTGTGCACCCACGGAAGTA<br>GAATTAAGAACTTCCGTAATTCACAGAAAAACGGCCAGTGGGACAGCGAAGAATTCGCCCTAACCGAA<br>GCTTTCAAAGTCTTTTCGTAAGATACGAGATAGACTATACAGCTGATCTAAAGACAGCTATTGTGGATG<br>AGAAGCAAAAAGACTTCTTTGTCGACCTTCTTAAGTTGTTCAAGTTAACTGTGCAGATGAGAAATAGTTG<br>GAAGGAAAAAGACCTAGATTACTTGATTAGCCCAGTCGCTGGTGCAGATGGCAGATTTTTTGATACACG |

TABLE 5-continued

| SEQ ID NO | Sequence |
|---|---|
| | TGAAGGCAATAAATCACTACCAAAAGACGCGGACGCTAATGGCGCATACAACATCGCATTGAAGGGTTT<br>GTGGGCTCTCAGGCAGATTAGGCAGACAAGTGAGGGTGGTAAGCTTAAGCTGGCGATTTCTAATAAGGA<br>ATGGTTACAGTTTGTTCAAGAAAGATCCTACGAAAAAGATTAA |
| SEQ ID NO: 133 | ATGAACAATGGTACTAATAATTTTCAAAACTTCATAGGGATTTCTAGCCTTCAAAAGACATTGAGAAAT<br>GCTTTAATTCCAACAGAAACGACTCAACAATTCATAGTGAAAAATGGTATTATAAAGAAGACGAGTTG<br>CGTGGCGAGAATAGACAAATTTTGAAAGATATCATGGATGACTACTACAGAGGGTTCATCTCCGAAACA<br>TTGTCTTCTATTGACGACATTGACTGGACCAGCTTATTCGAAAAAATGGAAATACAGCTGAAGAACGGA<br>GATAACAAGGACACTCTTATAAAGGAGCAAACGGAATATAGAAAAGGCTATACACAAAAAGTTTGCTAA<br>TGACGATAGATTTAAAAACATGTTTAGTGCGAAGTTAATTTCTGATATTCTACCCGAGTTTGTCATTCAT<br>AATAATAACTACTCTGCATCTGAAAAAGAGGAGAAGACCCAGGTTATAAAGTTGTTTTCAAGATTTGCC<br>ACATCATTTAAAGACTACTTCAAGAACAGGGCGAATTGCTTCTCTGCTGATGATATTAGCTCTTCCAGCT<br>GTCATAGAATTGTTAACGATAATGCCGAAATTTTTTTTAGTAATGGCCTTGGTATATAGACGCATAGTCAA<br>GTCACTAAGCAATGATGATATAAACAAGATTAGTGGTGATATGAAAGATAGCCTTAAAGAAATGAGCCT<br>TGAAGAGATATATTCATATGAGAAGTACGGTGAATTTATAACTCAAGAAGGAATTTCTTTTTATAACGAT<br>ATTTGTGGTAAGGTTAATTCTTTTATGAATTTGTATTGCCAGAAGAACAAGGAAAATAAGAATCTATATA<br>AACTACAAAAGTTGCATAAACAGATTTTGTGTATAGCTGATACATCCTACGAAGTTCCGTATAAATTTGA<br>ATCTGATGAGGAAGTTTATCAATCGGTAAACGGTTTTCTTGACAACATTTCCAGCAAACATATCGTTGAG<br>AGACTACGTAAATTGGACAACTATAATGGTTACAATCTAGATAAAATACATAGTGTCCAAGTTT<br>TATGAGTCTGTCTCTCAAAAGACATATCGTGATTGGGAGACCATTAATACTGCACTTGAAATTCATTATA<br>ACAACATATTGCCTGGTAACGGGAAGAGTAAAGCTGATAAGGTTAAAAAGGCCGTCAAAAACGACTTG<br>CAAAAGTCTATTACCGAGATAAATGAATTAGTGTCAAACTACAAACTATGCTCAGATGATAATATTAAA<br>GCGGAAACATACATCCACGAATTTCCCACATACTGAATAACTTTGAAGCTCAGGAGCTTAAATATAAC<br>CCGGAAATACACTTGGTTGAGAGCGAGTTAAAAGCATCTGAGTTGAAAAATGTATTAGACGTCATCATG<br>AATGCGTTTCATTGGTGTTCAGTTTTTCATGACTGAAGAATTAGTCGACAAAGATAACAATTTTTATGCCG<br>AATTAGAGGAAATATATGATGAAATTTATCCCGTAATTAGTTTATACAATCTAGTTAGAAATTATGTTAC<br>ACAAAAGCCGTATAGTACCAAGAAAATAAAGCTTAATTTCGGAATACCTACGCTTGCTGATGGTTGGTC<br>AAAAAGTAAAGAATATAGCAATAATGCAATAATTTTAATGAGAGATAACCTATATTATTTGGGTATTTTT<br>AACGCTAAGAACAAACCAGACAAGAAAATAATTGAAGGTAATACATCTGAAAACAAGGGCGACTATAA<br>AAAGATGATATACAATTTGCTCCCAGGTCCTAATAAAATGATTCCTAAGGTTTTCCTGAGTAGCAAGACT<br>GGCGTTGAAACTTACAAGCCTAGTGCGTATATCCTGGAGGGTTATAAACAGAACAAGCATATCAAATCC<br>TCTAAGGACTTCGATATCACCTTTTGCCATGACTTAATCGATTATTTTAAAAATTGTATCGCAATTCATCC<br>AGAATGGAAAAATTTCGGATTTGATTTTAGTGATACCAGCACTTACGAGGATATCTCTGGGTTCTACAGA<br>GAAGTGGAGTTGCAGGGCTACAAAATCGATTGGACTTACATATCTGAAAAGGACATAGATTTGCTGCAG<br>GAGAAAGGTCAGCTATATTTGTTTCAAATCTACAACAAAGACTTTTCTAAAAAGTCTACCGGTAATGAC<br>AATCTGCACACAATGTACTTGAAGAACTTATTCTCCGAGGAGAACTTAAAGGACATTGTACTCAAGTTG<br>AATGGAGAAGCCGAGATTTTTTTAGAAAGAGCAGTATAAAGAATCCTATAATCCACAAGAAGGGCTCA<br>ATTCTCTGTGAATAGGACGTATGAGGCAGAAGAAAAGGACCAATTTGAGGAATATACAAATTGTAAGAAA<br>AAACATCCCAGAAAATATCTACCAGGAATTATATAAGTATTTTAATGACAAATCTGATAAGGAACTGTC<br>TGACGAAGCCGCTAAGCTCAAGAATGTTGTGGGCCACCATGAAGCTGCTACTAATATAGTGAAGGACTA<br>CAGATATACCTACGATAAATATTTCCTGCATATGCCAATTACTATAAACTTCAAAGCAAATAAAACAGG<br>TTTTATAAATAGAATCCTGCAGTATTGCTAAAGAAAAGGATTTACATGTAATTGGGATTGATAGA<br>GGTGAACGCAATCTGATCTATGTCAGCGTAATAGATACTTGTGGTAATATTGTGGAACAAAAGTCCTTTA<br>ATATTGTGAACGGATATGATTACCAAATCAAGTTGAAACAACAAGAGGGAGCACGCCAAATTGCCCGTA<br>AGGAATGGAAAGAGATAGGTAAGATCAAGGAAATTAAGGAAGGTTATCTTTCATTAGTTATTCACGAAA<br>TTTCGAAGATGGTAATCAAATACAACGCAATAATTGCTATGGAGGACCTGTCATATGGATTTAAGAAAG<br>GTAGATTCAAGGTTGAGAGACAGGTATACCAGAAATTTGAAACTATGTTGATCAACAAATTAAATTACT<br>TAGTCTTTAAGGCACATATCAATAACGGAAAACGGCGGGCTTTTAAAAGGGTATCAACTTACATACATAC<br>CTGATAAGTTGAAAAATGTGGGTCATCAGTGTGGGTGCATCTTTTATGTTCCAGCCGCTTACACATCAAA<br>AATCGATCCTACTACTGGGTTCGTAAACATATTTAAATTTAAAGATCTAACCGTTGATGCAAAAAGAGA<br>GTTTATCAAGAAATTTGATAGCATTAGGTACGATTCAGAAAAAAAATCTATTCTGTTTTACTTTTGACTAC<br>AACAACTTTATAACGCAGAATACAGTGATGTCAAAATCGTCCTGGTCAGTGTATACTTATGGTGTTAGAA<br>TTAAGAGACGTTTCGTAAACGGTCGTTTTTCTAACGAGTCCGATACAATCGACATCACTAAAGATATGGA<br>AAAAACCTTTGGAAATGACAGATATAAACTGGAGAGATGGTCAACAAGATATAATCGATTA<br>TGAAATCGTACAGCATATTTTTGAAATTTTTCGCTTAACAGTTCAGATGCGTAACTCTCTTAGTGAGCTA<br>GAAGATAGAGATTATGATAGACTTATCTCGCCTGTTCTTAACGAAAATAATATCTTCTATGACTCGGCAA<br>AAGCCGGTGATGCACTTCCAAAAGATGCTGATGCAAATGGCGCGTACTGCATCGCATTGAAGGGGCTCT<br>ACGAGATTAAACAAATCACCGAAAACTGGAAGAAGATGGTAAATTTTCTAGGGATAAGTTGAAAATC<br>AGTAATAAAGATTGGTTCGATTTTATACAAAATAAGCGATACTTATAG |
| SEQ ID NO: 134 | ATGACCAATAAGTTTACTAATCAATACTCATTGTCTAAAACGTTAAGATTCGAGTTAATTCCCCAGGGAA<br>AGACACTAGAATTTATTCAAGAAAAAGGTCTTCTCTCTCAGGATAAACAAAGAGCAGAATCATACCAGG<br>AGATGAAAAAAACCATAGATAAATTTCATAAGTACTTCATCGACTTGGCACTATCGAACGCCAAGCTAA<br>CACATTTGGAAACCTACCTGGAGTTGTATAATAAATCGGCAGAGACGAAAAAGGAACAAAAATTCAAG<br>GATGACCTGAAGAAGGTTCAAGATAATCTGCGAAAGGAAATAGTGAAGTCGTTTAGTGATGGTGATGCA<br>AAGTCAATCTTTGCTATTTTAGACAAGAAGGAATTAATAACCGTGGAACTTGAAAGTGGTTTGAAAAT<br>AACGAACAGAAAGATATTTACTTCGACGAAAAATTTAAAACGTTTACTACGTACTTTTACAGGTTCCATC<br>AGAACCGCAAAAACATGTACTCCGTTGAACCAAACTCTACTGCAATCGCCTACAGATTAATACACGAAA<br>ATTTGCCTAAGTTTTTAGAAAATGCAAAGGCTTTTGAAAAGATAAAGCAAGTCGAATCGTTACAGGTAA<br>ACTTTCGCGAATTAATGGGCGAATTTGGAGATGAAGGTCTTATTTTTGTCAATGAATTAGAGGAAATGTT<br>TCAAATTAATTATTATAACGATGTCTTGAGTCAGACGGCCATTACTATCTACAACTCAATTATCAGTGGT<br>TTCACTAAGAATGATATAAAATATAAAGGTTTGAATGAATACATTAATAATTATAATCAAACTAAAGAT<br>AAGAAGGACAGGCTTCCGAAATTGAAGCAATTGTACAAGCAGATTCTAAGTGATAGGATTAGTTTGTCT<br>TTCCTTGCCAGACGCATTTACTGATGGCAAGCAAGTCTTAAAGGCTATATTCGATTTCTACAAGATTAACC<br>TACTTTCGTACACAATTGAAGGTCAAGAAGAATCTCAAAATCTGCTGCTTTTGATTAGGCAAACTATAGA<br>AAATTTGTCGTCCTTTGACACTCAAAAAATTTACCTGAAGAATGATACACACCTGACTACAATATCACAG |

TABLE 5-continued

| SEQ ID NO | Sequence |
|---|---|
| | CAGGTCTTTGGGGATTTTTCTGTCTTCTCCACGGCCCTAAACTATTGGTATGAGACAAAAGTTAATCCAA<br>AATTTGAAACAGAATATAGTAAGGCGAATGAAAAAAAGAGAGAAATTTTGGATAAAGCGAAGGCAGTA<br>TTCACAAAACAAGACTATTTTCTATCGCATTTCTCCAAGAAGTCTTATCCGAATATATTTTGACACTCGA<br>TCACACCTCTGATATAGTTAAGACACATTCGTCCAACTGCATCGCAGATTACTTCAAGAATCACTTCGTG<br>GCTAAGAAAGAAAACGAAACGGATAAAACTTTTGACTTCATTGCTAACATAACCGCTAAATACCAATGT<br>ATTCAGGGCATATTAGAAAATGCAGACCAGTACGAAGCGAGTTAAAACAGGACCAAAAGTTAATAGA<br>TAATCTAAAGTTTTTCTTAGATGCTATACTTGAGTTATTACATTTTATAAAGCCATTGCATCTAAAATCGG<br>AAAGTATTACTGAAAAAGACACTGCGTTCTATGATGTGTTCGAAAATTATTATGAGGCTTTATCTTTATT<br>GACCCCCCTTTACAACATGGTCCGCAATTATGTTACTCAGAAGCCTTACTCTACTGAAAAGATCAAATTA<br>AACTTTGAAAATGCTCAGTTGCTGAATGGTTGGGATGCCAATAAGGAAGGTGACTACCTGACGACTATT<br>CTAAAAAAAGACGGTAATTATTTCTTAGCAATCATGGATAAAAAACATAACAAGGCATTTCAAAAATTT<br>CCAGAAGGAAAGAAAACTATGAAAAGATGGTTTATAAATTGTTGCCTGGAGTTAATAAAATGTTGCCA<br>AAAGTTTTTTTAGCAATAAGAACATAGCTTACTTTAATCCATCTAAGGAACTGCTCGAGAACTACAAGA<br>AGGAAACACATAAAAAAGGTGATACATTTAATTTGGAACATTGCCATACTCTGATTGATTTTTTAAGGA<br>CTCTCTTAATAAACATGAAGACTGGAAATATTTTGATTTTCAATTTTCGGAAACTAAATCATACCAAGAT<br>CTAAGTGGATTTTACAGAGAAGTTGAACACCAAGGTTATAAGATTAACTTCAAGAATATAGATTCTGAA<br>TACATTGATGGTCTTGTAAACGAGGGTAAACTATTCCTGTTCCAAATCTACTCTAAGGACTTCTCACCTTT<br>TTCCAAAGGAAAACCTAATATGCATACGTTGTACTGGAAGGCTCTATTTGAAGAACAAAATTTGCAAAA<br>TGTAATCTACAAACTGAACGGCCAAGCTGAAATATTCTTCAGAAAAGCCTCAATTAAGCCAAAAAACAT<br>TATTCTTCATAAAAAGAAGATCAAGATTGCGAAGAAACATTTTATTGATAAGAAGACCAAGACTTCCGA<br>AATTGTACCAGTACAAACAATCAAGAATCTCAATATGTATTATCAAGGCAAGATAAGTGAGAAAGAGTT<br>AACCCAGGATGATTTACGTTATATAGACAATTTCTCTATATTCAACGAGAAGAACAAACAATAGACAT<br>TATCAAAGATAAAAGGTTTACTGTTGACAAATTTCAATTTCATGTGCCTATCACAATGAACTTTAAGGCC<br>ACAGGTGGTTCGTACATTAATCAAACTGTTTTAGAATATCTGCAAAATAACCCAGAGGTCAAGATCATC<br>GGTCTTGATAGGGGTGAGAGACATCTGGTGTATCTAACACTCATTCATCAACAAGGCAACATCTTGAAG<br>CAAGAATCATTGAACACTATCACAGACTCCAAGATCTCGACTCCATATCACAAACTCCTTGACAATAAA<br>GAAAACGAAAGGGATCTTGCCAGAAAAAATTGGGGTACAGTTGAAAATATTAAGGAACTAAAAGAAGG<br>TTACATTTCGCAAGTAGTTCACAAGATTGCAACACTCATGTGGAAGAAAACGCAATCGTTGTCATGGA<br>AGATTTAAATTTCGGATTTAAGAGGAAGATTTAAAGTAGAAAAGCAAATCTACCAGAAGTTGGAGA<br>AGATGTTAATTGACAAATTGAACTACTTAGTGCTGAAAGACAAACAGCCTCAAGAATTGGGCGGTCTAT<br>ACAACGCTTTACAACTGACAAATAAATTTGAGTCATTCCAAAAGATGGGTAAGCAGAGTGGTTTTTTGTT<br>TTATGTTCCGGCATGGAACACATCCAAAATCGATCCAACTACAGGCTTCGTGAATTATTCTACACTAAA<br>TATGAAAATGTGGATAAAGCAAAAGCTTTCTTTGAGAAGTTCGAGGCGATCCGTTTTAACGCTGAAAAG<br>AAGTACTTCGAGTTCGAGGTCAAAAAGTATTCAGATTTTAACCCCAAGGCTGAAGGCACCCAGCAAGCA<br>TGGACTATTTGCACGTACGGTGAGCGAATCGAAACTAAAAGGCAAAAGGATCAAAATAATAAGTTTGTA<br>AGCACACCCATTAACTTGACAGAAAAGATAGAAGATTTTCTTGGAAAAAACCAAATTGTATATGGTGAC<br>GGTAACTGTATCAAGTCACAAATTGCTTCTAAAGACGATAAGGCCTTCTTCGAAACTCTGCTATACTGGT<br>TTAAAATGACGTTGCAAATGAGAACAGTGAAACTAGAACTAGATCTGACTATTTAATATCACCCGTGA<br>TGAACGATAATGGTACCTTTTACAATTCAAGAGATTACGAGAAATTGGAGAACCCCACACTACCAAAAG<br>ACGCAGACGCTAATGGTGCCTACCATATTGCTAAAAAGGGACTGATGTTGTTGAACAAGATAGATCAAG<br>CCGACTTAACTAAAAAAGTTGATTTGTCAATTTCGAATAGAGATTGGTTGCAATTCGTCCAGAAAAATA<br>AGTAA |
| SEQ ID NO: 135 | ATGGAACAGGAATACTACTTGGGTTTGGATATGGGAACTGGTTCAGTCGGTTGGGCTGTTACGGACTCC<br>GAGTACCACGTGTTGAGAAAACACGGAAAGGCTTTATGGGGTGTCAGACTATTCGAATCAGCATCGACC<br>GCGGAAGAGAGAAGAATGTTTAGAACTTCAAGAAGAAGGCTCATCGTAGGAATTGGCGGATAGAAAT<br>TTTACAAGAAATATTCGCCGAAGAAATCTCTAAAAAAGATCCAGGATTTTTTCTACGTATGAAGGAATC<br>CAAATACTATCCGGAAGATAAACGTGATATTAATGGCAATTGTCCAGAGTTACCCTATGCTTTATTTGTG<br>GACGACGATTTCACCGATAAAGATTACCATAAGAAGTTCCCAACAATTTACCATCTGAGAAAGATGTTA<br>ATGAACACTGAAGAAACCCCGAATATAAGACTGGTCTATCTAGCCATTCATCATATGATGAAACACAGG<br>GGACACTTCTTGCTATCAGGGGATATAAATGAAATTAAAGAATTTGGTACAACATTTTCTAAATTATTGG<br>AAAATATTAAAACGAAGAATTAGATTGGAATTTAGAATTAGGCAAGGAGGAATACGCAGTTGTCGAA<br>TCGATTCTGAAAGATAACATGTTGAACAGATCAACGAAAAAACAAGGCTGATCAAGGCTTTAAAAGC<br>GAAATCAATATGCGAAAAAGCAGTATTGAATTTGTTAGCTGGGGGGACTGTCAAGTTGTCTGATATTTTC<br>GGATTGGAAGAATTGAATGAAACAGAGAGACCGAAGATATCCTTCGCCGATAATGGCTACGATGATTAT<br>ATAGGCGAAGTCGAAAATGAGCTGGGCGAACAATTCTACATTATCGAGACTGCCAAGGCTGTTTATGAT<br>TGGGCGGTGTTAGTCGAAATCCTTGGCAAATACACTTCCATCTCCGAAGCTAAGGTGGCAACCTACGAA<br>AAGCATAAAAGTGATTTGCAATTCCTTAAGAAAATTGTCCGAAAGTACTTGACCAAAGAAGAGTACAAG<br>GATATTTTCGTATCAACATCGGACAAACTGAAGAATTATTCAGCTATATTGGCATGACGAAAATTAATG<br>GTAAGAAAGTTGATTTGCAATCCAAGAGATGTTCTAAAGAAGAATTTTACGATTTCATTAAAAAAAATG<br>TCCTAAAAAGTTGGAGGGACAACCTGAATATGAGTATTTAAAGGAAGAACTGGAAAGAGAAACTTTC<br>CTACCAAAGCAAGTTAATCGTGATAATGGCGTTATTCCATACCAAATACACTTGTACGAATTAAAGAAG<br>ATCTTGGGTAACTTGAGGGACAAAATTGATTTAATCAAGGAAAATGTCCAAACATGTTAATTAGATGGTGAAA<br>GAATTTAGAATACCTTACTACGTGGGCCCTTTAAACAAAATAGACGATGGTAAGGAAGGGAAGTTCACA<br>TGGGCAGTCAGAAAGTCCAATGAAAAATTTACCCATGGAATTTCGAAAACGTTGTAGATATTGAGCT<br>TCTGCTGAGAAATTTATTAGGAGAATGACAAATAAATGCACTTATCTTATGGGGAAGACGTGTTGCCT<br>AAAGATAGTTTATTATATTCAAAGTATATGGTCTTAAATGAATTAAACAATGTTAATTAGATGGTGAAA<br>AACTTTCCGTCGAATTGAAACAAAGATTGTATACAGATGTATTCTGCAAATATAGAAAAGTAACTGTAA<br>AGAAGATTAAAACTACCTTAAATGTGAAGGCATTATCAGCGGAAATGTTGAGATCACTGGTATCGATG<br>GTGATTTTAAGGCATCTTTAACCGCATATCACGACTTTAAGGAAATATTGACGGGTACTGAGCTTGCTAA<br>AAAAGACAAAGAAGACAATTATCACCAATATCGTGCTCTTCGGAGACGACAAGAAATTATTGAAAAAGA<br>GATTGAACCGCCTATACCCTCAGATTACCCCTAACCAATTGAAGAAAATCTGCGCTCTGTCTTATACTGG<br>ATGGGGTCGTTTTAGCAAGAAGTTTCTAGAAGAAATTACTGCTCCGGATCCTGAAACTGGGGAAGTCTG<br>GAATATAATTACCGCGCTATGGGAATCGAATAATAATTTAATGCAATTACTATCTAATGAATACAGATTT<br>ATGGAAGAAGTCGAAACTTACAATATGGGAAACAAACAAAAACTTTGAGCTACGAAACAGTAGAGAA<br>TATGTATGTCTCACCATCTGTAAAGCGGCAGATCTGGCAAACCTTGAAGATAGTTAAAGAATTAGAAAA |

TABLE 5-continued

| SEQ ID NO | Sequence |
|---|---|
| | AGTGATGAAGGAAAGTCCAAAAAGGGTTTTTATTGAAATGGCCCGAGAAAAACAAGAATCTAAAAGGA<br>CGGAAAGTAGGAAAAAGCAACTTATAGATCTATATAAAGCCTGCAAAAATGAAGAAAAAGATTGGGTA<br>AAGGAATTAGGTGACCAGGAAGAGCAAAAATTGAGATCTGACAAGCTGTACTTGTATTATACGCAAAA<br>GGGCCGGTGTATGTATTCGGGTGAGGTAATAGAATTGAAAGATTTATGGGATAACACTAAGTATGACAT<br>TGACCATATTTACCCCCAGTCTAAGACAATGGACGATTCATTAAATAACCGAGTTCTTGTCAAAAAGAA<br>GTACAATGCCACAAAGAGCGATAAGTACCCATTGAACGAAAATATAAGACATGAACGAAAGGTTTCT<br>GGAAATCATTGTTGGACGGTGGATTTATTTCCAAAGAAAAATACGAGAGATTGATTAGAAACACTGAAC<br>TATCTCCAGAGGAGTTAGCTGGCTTTATCGAAAGACAAATTGTTGAAACATAGACAGTCTACAAAAGCAG<br>TTGCAGAAATCTTAAAACAAGTATTTCCAGAATCCGAAATTGTGTACGTCAAAGCCGGAACAGTAAGTA<br>GATTTAGAAAAGACTTTGAATTATTGAAAGTACGAGAGGTTAACGACCTACATCATGCTAAGGATGCTT<br>ATTTAAATATAGTCGTTGGTAATTCGTATTACGTGAAATTCACAAAAAACGCATCTTGGTTCATCAAGGA<br>GAATCCTGGTAGGACATACAACTTGAAAAGATGTTTACATCAGGATGGAATATCGAAAGAAATGGTGA<br>GGTTGCGTGGGAGGTAGGCAAGAAGGGAACCATTGTTACTGTAAAGCAAATTATGAATAAAAACAATA<br>TACTTGTTACGAGACAGGTGCACGAAGCCAAAGGAGGGTTGTTTGACCAGCAAATCATGAAGAAAGGT<br>AAAGGTCAGATAGCAATAAAAGAGACTGATGAGCGTTTAGCTAGTATAGAAAAATATGGGGGCTACAA<br>TAAGGCAGCTGGTGCTTACTTCATGTTGGTCGAATCAAAGGATAAAAAAGGGAAGACGATCCGGACCAT<br>AGAGTTTATCCCTCTGTACTTGAAGAATAAGATTGAGTCTGACGAAAGCATCGCATTGAATTTCTTGGAA<br>AAGGGGCGCGGTCTAAAGGAGCCAAAAATATTGTTAAAGAAAATTAAAATAGACACCCTATTCGACGTC<br>GATGGGTTTAAGATGTGGCTTAGTGGTCGTACTGGGGACAGATTATTATTCAAGTGTGCCAATCAGTTAA<br>TCCTTGACGAGAAAATCATTGTTACAATGAAAAAAATTGTTAAGTTTATTCAAAGGCGACAAGAAAATA<br>GAGAACTAAAGTTGAGTGATAAGGATGGAATCGATAATGAAGTGTTAATGGAGATTTATAACACTTTTG<br>TCGACAAATTGGAGAATACGGTACAGAATTAGGCTATCTGAACAGGCTAAAACCCTAATTGATAAAC<br>AGAAGGAGTTTGAGCGACTTTCTCTTGAAGACAAATCTTCAACTCTTTTCGAGATCCTACATATCTTTCA<br>GTGTCAATCTTCTGCAGCTAATTTGAAAATGATTGGAGGTCCTGGTAAGGCTGGTATATTAGTCATGAAC<br>AACAACATATCTAAGTGTAATAAGATTAGTATAATTAACCAATCACCGACAGGTATCTTTGAAAATGAA<br>ATTGATTTACTTAAA |
| SEQ ID NO: 136 | ATGAAATCATTCGACTCGTTCACCAACTTGTACTCCCTGTCTAAAACATTGAAATTTGAAATGCGACCTG<br>TTGGTAACACCCAAAAGATGTTAGATAATGCAGGAGTTTCGAAAACTGATCCAGAAAAAAT<br>ACGGTAAAACGAAACCATATTTCGATAGGTTGCATCGGGAATTTATAGAAGAAGCTTTGACTGGTGTAG<br>AATTAATTGGCTTAGATGAGAATTTCCGTACTCTAGTCGATTGGCAAAAAGATAAAAAGAACAATGTTG<br>CCATGAAGGCATACGAAAATAGTCTACAAAGACTAAGAACAGAGATCGGGAAAATTTTCAATTTGAAG<br>GCAGAAGACTGGGTGAAGAACAAATATCCAATATTGGGTCTTAAGAATAAGAATACTGATATATTGTTC<br>GAGGAGGCCGTTTTCGGTATTCTTAAGGCAAGATATGGTGAAGAGAAAGACACGTTTATTGAAGTTGAG<br>GAGATTGATAAAACCGGTAAGTCCAAAATCAACCAGATCTCTATCTTCGACAGTTGGAAGGGCTTCACT<br>GGTTATTTTAAGAAGTTCTTCGAAACTAGGAAGAACTTCTATAAAAACGATGGTACTTCCACGGCTATTG<br>CTACAAGAATTATCGACCAAAACCTTAAGCGTTTTATTGATAACCTATCAATTGTTGAAAGTGTTCGACA<br>GAAAGTAGATTTGGCTGAAACTGAAAAATCTTTTAGTATCTCCTTATCCCAGTTTTTCTCTATAGATTTT<br>ATAATAAATGTTTGCTGCAAGATGGCATTGACTACTATAATAAATAATTGGTGGAGAGACATTGAAAA<br>ACGGAGAGAAGCTGATTGGCCTTAATGAGTTGATAAATCAATATAGACAAAATAATAAGGACCAGAAA<br>ATCCCTTTCTTTAAATTGCTAGACAAACAGATTTTGTCTGAAAAGATCCTATTCTTGGATGAAATAAAGA<br>ACGATACTGAATTGATTGAAGCTTTGTCCCAGTTTGCTAAAACGATGAAGAAAAGACAAAGATTGTGA<br>AAAAATTGTTTGCTGATTTCGTAGAAAACAATTCTAAATATGATCTAGCCCAGATTTATATAAGTCAAGA<br>AGCTTTCAATACAATAAGTAATAAGTGGACAAGTGAAACAGAAACTTTTGCTAAGTATTTATTCGAAGC<br>CATGAAGTCTGGTAAACTTGCCAAATACGAAAAAAAAGATAACAGTTATAAATTTCCAGACTTTATAGC<br>CCTTTCACAGATGAAGTCTGCCTTATTGTCGATATCCTTAGAAGGTCATTTTTGGAAGGAAAAATTAT<br>AAGATAAGCAAGTTCCAAGAAAAGACTAATTGGGAACAATTTTTGGCTATATTTCTATATGAGTTCAATT<br>CATTATTTTCCGATAAAATCAACACTAAGGATGGAGAGACTAAGCAAGTTGGCTACTATTTGTTCGCAA<br>AAGATCTGCACAATTTGATTCTATCAGAACAAATAGATATACCAAAAGATTCAAAGGTAACTATAAAGG<br>ATTTCGCAGATTCCGTCCTCACCATTTATCAAATGGCTAAATATTTTGCCGTTGAAAAAAAGAGAGCGTG<br>GTTAGCAGAATACGAGTTGGACTCGTTTTATACTCAGCCAGATACTGGATACTTGCAATTCTACGATAAT<br>GCATACGAAGACATTGTACAGGTATACAATAAACTTAGAAATTACTTAACCAAGAAGCCCTACAGTGAA<br>GAAAAATGGAAGCTGAACTTTGAAAATTCGACTTTGGCAAATGGTTGGGATAAAAATAAAGAAAGTGA<br>CAACTCCGCAGTGATTTTGCAAAAGGGTGGGAAATATTACTTGGGTTTAATCACAAAAGGCCACAATAA<br>GATTTTTGATGATAGATTTCAAGAAAAATTCATAGTTGGTATAGAAGGTGGCAAATACGAGAAAATTGT<br>CTATAAATTCTTCCCTGATCAAGCCAAAATGTTCCCAAAAGTTTGCTTTTCTGCTAAAGGATTGGAGTTTT<br>TCCGGCCTAGCGAGGAGATCCTTCGTATCTACAACAATGCTGAATTCAAAAAAGGGAGAAACCTATAGCA<br>TAGATTCTATGCAAAAACTGATAGATTTTTATAAGGATTGTTTAACAAAGTACGAAGGCTGGGCCTGCTA<br>TACATTTAGACATTTAAAGCCCACAGAAGAATACCAAAATAACATTGGTGAATTCTTTCGGGACGTTGC<br>CGAAGACGGCTATAGGATCGATTTTCAAGGTATCTCAGATCAATATATCCACGAAAAGAACGAGAAGGG<br>TGAGCTGCACCTTTTCGAAATTCATAATAAGGACTGGAATTTGGATAAGGCGAGAGATGGTAAATCGAA<br>GACCACTCAAAAGAACTTGCATACTTTATATTTTGAGTCCTTGTTTTCTAATGATAACGTCGTCCAAAATT<br>TTCCAATAAAGTTGAATGGACAAGCGGAAATTTTCTATCGGCACAGAGAAAGACAAATTAGAT<br>CAAAGAAAGATAAAAAGGGAAATAAAGTCATTGATCACAAACGATACTCTGAGAATAAAATATTTTCC<br>ACGTACCATTGACACTCAACAGGACTAAGAATGACTCTTATAGATTTAATGCTCAGATTAATAATTTTTT<br>GGCAAATAACAAGGATATTAACATAATTGGGGTGGATAGAGGTGAAAAGCACTTGGTATATTACTCTGT<br>CATCACTCAGGCTTCTGATATATTGGAAAGCGGGTCTCTAAATGAATTGAACGGTGTTAACTACGCCGA<br>AAAGCTAGGTAAAAAAGCTGAAAACAGAGAGCAGGCTCGGCGCGATTGGCAAGATGTTCAAGGAATTA<br>AAGACCTTAAAAAAGGCTACATTAGTCAAGTAGTTAGAAAGTTAGCCGATCTTGCTATTAAACATAACG<br>CAATCATTATTCTGGAGGACCTAAATATGCGTTTTAAGCAAGTTAGGGGTGGCATAGAAAAAAGTATTT<br>ATCAGCAGCTTGAGAAGGCTTTGATAGATAAGTTATCGTTCCTAGTTGACAAAGGTGAAAAAAATCCTG<br>AACAAGCTGGTCATCTGTTGAAAGCTTATCAGCTGAGCGCACCTTTTGAAACATTTCAAAAAATGGGAA<br>AACAAACAGGTATTATTTCTATACTCAAGCGAGTTATACAAGTAAATCTGACCCAGTGACAGGATGGA<br>GACCACACCTTTATCTAAAATATTTTTCTGCTAAAAAGGCCAAAGATGACATCGCTAAGTTTACAAAAAT<br>AGAATTTGTCAACGATAGATTTGAATTGACTTACGATATTAAAGATTTTCAGCAAGCAAAGAATACCC<br>AAATAAGACAGTGTGGAAAGTATGCTCCAATGTGGGAGAGATTTAGATGGGATAAAAATCTCAATCAAA |

| SEQ ID NO | Sequence |
|---|---|
| | ACAAGGGTGGTTACACACATTATACTAATATAACTGAAAATATTCAAGAATTGTTTACTAAGTACGGAA<br>TTGACATAACCAAAGACTTACTAACTCAGATTTCAACTATTGACGAAAAACAAAATACCTCATTTTTCCG<br>CGACTTTATTTTTTATTTCAACTTGATCTGTCAAATTCGTAACACGGATGATTCCGAAATTGCCAAGAAG<br>AACGGAAAAGATGATTTCATCCTATCTCCAGTGGAACCATTTTTTGACTCAAGAAAAGATAATGGTAAT<br>AAGTTGCCTGAGAACGGAGATGATAACGGCGCTTATAATATCGCTCGGAAGGGTATTGTAATTCTTAAT<br>AAAAATATCTCAGTACTCTGAAAAGAACGAAAACTGCGAGAAAATGAAGTGGGGCGACTTGTATGTATCT<br>AATATAGATTGGGATAATTTCGTTACTCAAGCCAACGCGAGACATTGA |
| SEQ ID NO: 137 | ATGGAAAATTTTAAAAACCTATATCCAATTAATAAGACACTTAGATTCGAGCTTAGGCCATACGGCAAA<br>ACACTAGAAAATTTTAAGAAGTCAGGCCTATTAGAAAAAGACGCCTTTAAGGCAAATTCCAGAAGATCA<br>ATGCAGGCAATTATTGATGAGAAATTTAAAGAGACTATCGAGGAAAGGTTGAAATACACTGAATTCTCT<br>GAGTGCGATCTGGGAAACATGACTTCCAAGGATAAAAAGATTACCGATAAGGCTGCTACCAACCTCAAA<br>AAGCAAGTCATCTTATCGTTTGATGATGAAATTTTTAATAACTACTTAAAGCCGGACAAAAACATTGACG<br>CCCTATTCAAAAATGATCCGTCCAACCCCGTAATTTCAACTTTTAAGGGTTTTACCACGTACTTTGTAAAT<br>TTTTTTGAGATTCGTAAACATATCTTCAAAGGAGAATCGTCGGGTTCCATGGCCTATAGGATAATTGATG<br>AAAATCTTACGACTTACTTAAACAATATCGAAAAGATAAAAAGTTACCAGAAGAATTAAAGTCTCAAT<br>TGGAAGGTATTGACCAAATAGACAAATTAATAACTATAATGAGTTCATAACTCAAAGCGGTATCACAC<br>ATTACAATGAAATTATCGGTGGTATATCTAAAAGTGAGAACGTAAAAATACAGGGAATAAACGAGGGG<br>ATCAATCTATACTGTCAGAAGAATAAAGTAAATTACCAAGACTAACGCCATTATACAAATGATTCTG<br>TCTGATAGAGTTTCCAACTCGTTCGTGCTTGATACTATAGAAATGATACTGAATTAATTGAGATGATTA<br>GCGACTTGATTAATAAAACAGAAATATCTCAAGACGTAATAATGTCAGAACATTTTCATAA<br>AATATAAACAGCTTGGTAATTTACCGGGGATAAGTTACTCTAGCATCGTGAATGCTATTTGCTCCGATTA<br>TGACAATAATTTTGGTGACGGAAAAAGAAAAAAATCATATGAGAACGATAGGAAGAAACACCTTGAAA<br>CAAACGTATACTCAATTAACTATATATCGGAACTGTTAACAGACACCGATGTATCATCTAATATAAAAAT<br>GAGATATAAGGAACTTGAACAAAATTACCAGGTGTGTAAGGAGAATTTCAATGCTACCAACTGGATGAA<br>CATTAAGAATATTAAACAGAGTGAAAAGACAAACTTGATTAAAGATCTACTAGATATACTGAAATCAAT<br>ACAGAGATTCTACGATCTGTTTGATATAGTTGATGAAGACAAAAATCCTAGTGCTGAGTTTTACACGTGG<br>CTAAGTAAAAATGCGGAAAAGTTAGATTTCGAGTTCAACTCTGTTTATAATAAATCTAGGAATTATTTAA<br>CTAGAAAGCAGTATTCTGATAAAAAGATAAAATTGAACTTCGACTCCCCTACGTTGGCAAAGGGTTGGG<br>ATGCAAACAAAGAAATCGATAACTCCACCATAATAATGCGTAAGTTTAACAATGATAGGGGGGATTACG<br>ATTATTTTTGGGAATTTGGAACAAATCTACCCCAGCGAATGAAAAATTATTCCCCTTGAAGACAATGG<br>TCTTTTTGAAAAAATGCAGTATAAATTATATCCAGACCCATCCAAGATGCTTCCAAAGCAATTTCTGTCA<br>AAAATTTGGAAGGCTAAACACCCTACTACTCCTGAATTTGATAAGAAGTATAAGGAGGGCCGACACAAA<br>AAGGGTCCAGATTTTGAAAAAGAATTCCTGCATGAATTGATAGATTGTTTTAAGCATGGTTTGGTAAATC<br>ATGATGAAAAATATCAGGATGTCTTTGGATTCAATTTGAGAAATACAGAGGATTACAACTCATATACAG<br>AATTTCTCGAGGACGTCGAACGTTGCAATTATAATCTCAGTTTCAACAAGATCGCAGACACTTCAAACTT<br>AATTAACGACGGAAATTGTACGTTTTTCAAATCTGGTCGAAAGACTTTAGTATTGATTCAAAGGGTACA<br>AAAAACCTAAATACAATATATTTCGAAAGTCTATTCTCGGAAGAACATGATCGAAAAAATGTTCAAA<br>CTGTCAGGCGAAGCTGAAATATTCTACCGTCCCGCAAGCCTTAATTATTGTGAGGATATCATTAAAAAA<br>GGACATCACCATGCAGAGTTAAAAGATAAATTCGATTACCCAATAATTAAAGATAAAAGATACTCCCAG<br>GATAAGTTCTTTTTCCATGTACCTATGGTTATTAACTACAAGTCGGAAAAACTAAACTCGAAGTCATTAA<br>ATAATAGAACTAACGAGAACTTGGGACAATTCACACACATAATTGGTATTGATCGTGGCGAAAGACATT<br>TAATATATCTGACTGTTGTTGATGTTTCAACAGGAGAAATTGTTGAACAGAAACATCTTGATGAAATTAT<br>AAAACACAGATACAAAAGGCGTTGAGCATAAAACTCATTATCTAAATAAATTGGAGGAAAAGTCGAAGA<br>CTCGCGATAACGAGAGAAAGAGTTGGGAAGCAATTGAAACCATAAAAGAGCTTAAAGAAGGTTACATT<br>AGTCACGTCATCAATGAAATACAAAAGTTCAAGAAAAGTATAACGCTTTGATTGTAATGGAAAATCTA<br>AATTATGGTTTTAAGAATTCAAGAATCAAAGTCGAAAAGCAGGTCTATCAGAAATTTGAAACGGCACTT<br>ATTAAAAGTTTAACTACATTATTGATAAAAAGGACCCAGAAACTTATATTCATGGTTACCAACTGACG<br>AACCCCAATCACAACATTGGACAAAATTGGAAACCAAAGTGGAATTGTTTTATACATTCCAGCTTGGAAT<br>ACATCCAAAATAGACCCTGTCACGGGGTTTGTCAACTTGTTATATGCCGACGATTTAAAGTATAAAAACC<br>AAGAACAAGCAAAGTCTTTTATTCAAAAGATTGATAATATTTATTTCGAAAACGGTGAATTAAATTCGA<br>CATAGATTTTTCTAAATGGAACAACCGTTATTCAATAAGTAAAACTAAATGGACACTCACCTCATACGGC<br>ACTCGTATCCAAACCTTTCGGAATCCCCAAAAAAATAACAAATGGGATTCTGCAGAATACGACTTGACC<br>GAGGAATTTAAATTAATTCTTAATATAGACGGTACACTCAAAAGTCAAGACGTGGAGACATACAAGAAG<br>TTTATGTCGTTATTCAAGCTTATGCTTCAGTTGAGGAACTCCGTTACAGGCACTGATATTGATTACATGAT<br>TTCACCAGTAACGGATAAGACTGGGACTCATTTCGATTCTAGGGAAAATATTAAAAATTTACCTGCTGAC<br>GCAGACGCAAACGGCGCATACAATATAGCAAGAAAGGGATTATGGCCATTGAGAATATTATGAATGG<br>CATATCAGATCCATTAAAGATAAGCAATGAAGACTACTTAAAATACATTCAGAATCAGCAAGAATAA |
| SEQ ID NO: 138 | ATGACCCAGTTTGAAGGTTTCACCAATTTGTACCAAGTAAGTAAAACCTTGAGGTTCGAATTGATCCCAC<br>AGGGCAAGACATTGAAGCATATTCAAGAGCAAGGATTTATAGAAGAAGATAAAGCGAGAAACGATCAC<br>TATAAAGAGTTAAAACCCATTATTGACAGGATCTATAAAACATACGCCGATCAATGCCTTCAATTAGTG<br>CAATTAGATTGGGAAAACTTGAGCGCTGCCATCGATTCCTACGGAAGGAAAAACAGAAGAAACAAG<br>AAATGCCTTAATCGAGGAACAAGCAACCTATAGAAACGCTATACACGATTACTTCATCGGTAGAACTGA<br>TAATCTAACAGATGCAATAAATAAGAGACATGCTGAGATATATAAAGGACTATTTAAAGCAGAATTATT<br>CAACGGAAAGGTGTTGAAACAGTTAGGTACCGTTACAACTACTGAGCATGAAAATGCCTTGCTGAGAAG<br>CTTTGACAAGTTTACTACCTACTTTTCGGGTTTCTACGAAAATCGCAAAAATGTATTTCTGCGGAAGAT<br>ATTTCAACTGCAATCCCTCATAGGATTGTTCAAGATAATTTCCCTAAGTTTAAAGAGAACTGTCACATTT<br>TTACAAGGTTAATTACTGCGGTTCCAAGTCTAAGAGAACATTTTGAGAATGTAAAAAAAGCGATTGGTA<br>TATTTGTATCCACTAGCATTGAAGAGGTTTTCAGCTTCCCTTTTTATAACCAATTACTTACCCAAACACAG<br>ATCGACCTGTACAACAATTGTTAGGTGGTATATCGAGGGAGGCTGGTACGGAAAAGATTAAAGGATTA<br>AATGAAGTTCTTAATTTGGCCATACAAAAAAATGATGAAACGCGCACATTATCGCATCTTTACCACATA<br>GGTTTATACCGTTATTCAAGCAAATATTATCTGATCGTAATACCTTATCGTTCATATTAGAGGAGTTTAA<br>ATCTGACGAAGAAGTTATACAATCTTTTTGCAAGTATAAGACGCTATTGAGAAACGAAAACGTTCTGGA<br>AACAGCCGAAGCACTGTTCAATGAATTAAACAGTATCGACTTGACTCATATTTTTATATCGCATAAAAG<br>TTGGAGACAATTTCTTCAGCATTGTGCGATCACTGGGACACTTTAAGGAACGCACTATATGAACGTAGG |

TABLE 5-continued

| SEQ ID NO | Sequence |
|---|---|
| | ATCTCAGAATTGACAGGTAAGATAACGAAGTCTGCTAAAGAGAAAGTGCAGAGATCCCTAAAACACGA<br>GGATATAAATTTGCAGGAGATAATTTCAGCTGCAGGTAAAGAGTTGTCTGAAGCGTTCAAGCAAAAGAC<br>TTCCGAAATCTTGTCACACGCACACGCCGCATTAGATCAACCTTTACCCACTACTTTGAAAAAACAAGAA<br>GAGAAGGAGATATTAAAATCACAACTTGATTCTTTACTTGGCCTTTATCATCTTTTAGATTGGTTCGCTGT<br>TGACGAGAGCAATGAAGTGGATCCAGAGTTTTCCGCAAGATTGACCGGTATAAAGTTGGAAATGGAACC<br>TTCGTTATCATTTTACAACAAAGCTAGGAACTATGCTACAAAAAAACCTTATTCTGTCGAAAAATTTAAA<br>CTGAACTTCCAAATGCCTACTCTAGCAAGTGGCTGGGATGTTAATAAAGAAAAGAACAATGGCGCTATT<br>TTGTTTGTAAAAAATGGCCTATACTATCTTGGAATTATGCCTAAACAAAAAGGTCGCTACAAGGCTTTGT<br>CATTTGAACCTACTGAAAAGACTAGCGAAGGTTTCGATAAGATGTATTACGATTATTTCCCGGATGCCGC<br>TAAAATGATCCCCAAGTGCTCTACTCAATTGAAGGCAGTAACTGCTCATTTCCAAACGCATACCACGCCA<br>ATACTGCTTTCTAACAACTTTATAGAACCACTAGAAATAACGAAAGAAATTTACGACCTAAATAACCCA<br>GAGAAAGAACCAAAAAGTTCCAGACGGCCTACGCCAAAAAGACAGGGGACCAAAAAGGTTACCGCG<br>AGGCGTTATGTAAATGGATTGATTTTACTAGGGACTTTTTATCAAAATACACTAAAACGACGTCTATTGA<br>TCTTAGCTCCTTACGCCCGTCCTCCCAATACAAGGATCTAGGTGAGTATTACGCAGAGTTGAACCCGCTA<br>TTATACCATATTTCCTTCCAAAGGATTGCTGAAAAGGAAATTATGGACGCTGTTGAAACTGGGAAATTGT<br>ACCTGTTTCAGATTATAATAAGGACTTCGCAAAGGGTCACCATGGTAAGCCTAACCTTCACACTTTGTA<br>CTGGACCGGACTATTCTCGCCTGAAAATTTGGCTAAAACAAGTATCAAGTTAAACGGTCAGGCCGAGTT<br>ATTTTATAGACCCAAATCTAGAATGAAAAGAATGGCCCATAGATTAGGCGAAAAGATGTTAAACAAGA<br>AATTAAGGACCAAAAAACCCCGATACCAGACACTCTATACCAAGAACTGTACGACTATGTGAATCACA<br>GGCTTAGTCACGATTTATCAGATGAAGCGAGGGCTTTATTGCCAAATGTCATCACCAAGGAAGTATCAC<br>ATGAAATAATTAAGGATAGAAGGTTCACATCTGATAAATTCTTTTTTCATGTCCCAATTACATTGAATTA<br>TCAAGCAGCGAACTCACCATCTAAATTTAATCAGCGCGTCAACGCCTATTTGAAAGAACATCCCGAAAC<br>ACCAATCATCGGCATAGATCGAGGTGAGAGAAACTTAATATATATAACTGTGATTGATTCTACAGGAAA<br>AATCCTGGAGCAACGATCTTTAAATACCATACAACAGTTTGATTATCAAAAAAAGTTGGATAACAGAGA<br>AAAAGAACGTGTTGCCGCTAGGCAGGCTTGGTCTGTGGTAGGACAATTAAGGACTTAAAGCAGGGCTA<br>TCTGTCCCAAGTTATTCATGAAATAGTCGATCTGATGATACATTATCAGGCAGTTGTCGTGTTGGAAAAT<br>TTGAATTTTGGCTTTAAATCAAAAAGAACTGGCATAGCAGAAAAAGCTGTGTACCAGCAGTTTGAAAAG<br>ATGTTAATCGATAAGCTAAACTGCCTTGTTCTTAAAGATTACCCCGCAGAAAAAGTAGGTGGTGTTCTTA<br>ATCCATATCAGTTGACAGACCAATTTACATCCTTTGCGAAAATGGGTACGCAAAGCGGGTTCTTATTCTA<br>CGTACCGGCCCCCTATACTTCTAAGATCGACCCACTAACAGGTTTTGTGGACCCTTTTGTTTGGAAGACG<br>ATAAAGAACCACGAGTCACGCAAACATTTCTTAGAGGGCTTTGATTTCTTGCACTACGACGTGAAAACT<br>GGTGATTTTATCTTACACTTTAAAATGAACAGAAATCTCTCTTTCCAACGTGGACTGCCCGGATTCATGC<br>CGGCTTGGGACATCGTTTTTGAAAAGAATGAAACGCAGTTTGACGCCAAAGGTACACCATTTATAGCGG<br>GTAAGAGAATTGTGCCGGTCATAGAAAACCATAGATTTACAGGTAGATAGGGATCTGTACCCTGCTA<br>ATGAATTGATTGCATTACTCGAAGAGAAAGGAATTGTGTTTCGAGATGGATCGAATATTTTACCTAAGTT<br>GTTGGAAAATGATGATTCACACGCAATTGATACTATGGTTGCCCTCATAAGATCGGTATTGCAAATGAG<br>AAACTCAAATGCTGCTACGGGAGAGGATTATATAAACAGCCCCGTTCGCGATCTTAATGGTGTTTGTTTT<br>GATTCACGTTTTCAGAACCCCGAATGGCCAATGGATGCCGACGCAAACGGAGCATATCATATTGCTCTT<br>AAAGGCCAACTACTATTAAATCACTTAAAGGAATCCAAAGACCTAAAATTGCAAAACGGGATATCTAAT<br>CAGGATTGGCTGGCTTACATACAAGAACTACGTAACTAG |
| SEQ ID NO: 139 | ATGGCCGTTAAGTCAATCAAAGTGAAACTTAGACTGGATGACATGCCAGAGATTCGTGCGGGGTTATGG<br>AAACTTCATAAGGAAGTTAACGCAGGGGTAAGATATTATACCGAATGGTTATCATTACTTCGACAAGAG<br>AATTTGTACAGAAGGTCCCCGAACGGCGACGGTGAGCAAGAATGCGATAAGACGGCTGAAGAATGTAA<br>GGCAGAACTTTTGGAGCGCCTGAGAGCCCGTCAGGTTGAAAATGGCCATAGAGGTCCTGCGGGATCTGA<br>TGATGAGCTTTTACAGCTAGCTAGACAATTGTATGAATTGTTTGGTCCCTCAGGCTATTGGGGCTAAAGGA<br>GACGCTCAACAAATCGCCAGAAAGTTCTTGTCACCTCTGGCTGACAAAGATGCCGTGGGAGGATTAGGT<br>ATCGCTAAAGCAGGTAATAAACCAAGATGGGTTAGAATGAGAGAAGCAGGCGAACCTGGTTGGGAAGA<br>AGAGAAAGAAAGGCCGAAACTAGAAAAAGCGCTGACAGAACCGCAGATGTTTTACGGGCCTTGGCTG<br>ATTTTGGACTGAAGCCTTTGATGAGAGTGTATACTGATTCAGAAATGTCTTCCGTTGAATGGAAGCCCCT<br>AAGGAAGGGACAAGCGGTCAGAACCTGGGATAGGGATATGTTTCAACAGGCTATTGAAAGGATGATGT<br>CATGGGAATCCTGGAATCAAAGAGTAGGTCAAGAATACGCTAAACTGGTCGAACAAAAGAATAGATTT<br>GAACAAAAAATTTTGTAGGTCAAGAACATTTAGTACATTTGGTTAATCAACTTCAACAAGATATGAAA<br>GAGGCATCTCCTGGTTTGGAATCAAAAGAACAAACAGCACACTATGTTACCGGCCGAGCTTTGCGAGGT<br>TCTGACAAAGTATTTGAAAAGTGGGGGAAATTAGCTCCCGATGCCCCCTTTGATCTATATGATGCTGAAA<br>TTAAAAACGTTCAAAGAAGGAACACTAGACGTTTTGGATCCCATGATCTTTTTGCAAAGCTAGCTGAGC<br>CAGAATACCAGGCTCTATGGCGTGAAGACGCCTCGTTTTTGACTAGATACGCAGTATACAATTCAATACT<br>CAGAAAAACTAAACCATGCCAAGATGTTTGCTACATTCACCCTGCCCGATGCTACCGCTCATCCTATTTGG<br>ACTAGATTTGACAAGTTGGGGGGGAATCTACATCAGTACACATTTTTATTTAATGAATTCGGTGAAAGA<br>AGACACGCTATTAGATTCCACAAGCTCCTAAAGGTTGAAAACGGCGTTGCGAGAGAAGTTGATGATGTA<br>ACAGTTCCCATTTCTATGTCGGAGCAATTGGATAATCTATTGCCTAGAGACCCTAATGAACCAATTGCTT<br>TGTACTTTCGTGACTACGGTGCAGAACAACACTTTACAGGTGAATTCGGCGGAGCCAAGATTCAATGTA<br>GACGTGATCAACTCGCACACATGCATAGAGAAGAGGCGCTCGTGATGTTTATTTAAATGTGCTGTTA<br>GAGTTCAATCCCAATCGGAGGCTAGAGGTGAAAGAAGGCCACCATACGCAGCAGTTTTTAGGTTAGTAG<br>GTGATAATCATAGGGCATTTGTCCACTTCGACAAATTAAGTGATTATTTAGCAGAGCACCCTGATGATGG<br>AAAGTTGGGCAGTGAGGGATTATTAAGTGGGTTGAGGGTAATGTCTGTAGATCTTGGTCTTCGTACTTCT<br>GCGAGTATCTCTGTCTTTAGAGTACACGTAAGGATGAGTTGAAACCTAATAGCAAAGGAAGAGTCCCG<br>TTTTTTTTTCCTATTAAGGGTAACGATAACCTGGTGGCCGTGCATGAAAGATCACAACTTTTGAAATTGC<br>CAGGAGAAACGGAGTCCAAGGACTTGAGGGCAATTAGAGAGGAACGTCAGCGTACATTGCGACAGCTG<br>AGAACTCAATTGGCTTATTTGAGGTTGTTGGTTAGGTGTGGTTCCGAGGATGTTGGCAGAAGAGAAAGG<br>TCTTGGGCCAAATTGATAGAACAACCAGTGGACGCCGCAAATCACAGATTGGAGAGAAGCCCG<br>TTCGAAAATGAACTCCAGAAATTAAAGAGCCTACATGGCATATGCTCTGATAAAGAGTTGGATGGATGCC<br>GTATACGAATCCGTTCGTAGAGTCTGGCGCCACATGGGTAAGCAAGTACGGGACTGGAGAAGGATGTT<br>CGTTCCGGCGAAAGACCGAAGATAAGGGGGTATGCAAAGGACGTTGTAGGCGGTAATTCTATTGAACA<br>GATTGAGTATTTGAAAGGCAGTACAAATTTCTTAAATCCTGGAGCTTCTTCGGCAAAGTGTCAGGACA<br>AGTCATCAGGGCTGAAAAAGGTTCCAGATTTGCTATTACGCTAAGGGAACATATTGATCATGCGAAAGA |

TABLE 5-continued

| SEQ ID NO | Sequence |
|---|---|
| | AGATAGACTGAAAAAACTAGCAGATAGAATAATTATGGAAGCACTTGGTTACGTCTATGCACTTGATGA<br>AAGAGGCAAGGGGAAATGGGTAGCTAAATACCCGCCTTGTCAACTTATTTTATTAGAAGAATTAAGCGA<br>GTACCAATTTAACAACGATAGACCTCCATCCGAAATAATCAGCTGATGCAATGGTCCCATAGGGGTGT<br>TTTTCAAGAATTGATAAATCAAGCTCAAGTACACGATTTGCTAGGTACTATATGTACGCAGCGTTTTCG<br>AGCCGTTTTGATGCAAGAACTGGTGCCCCAGGTATCAGATGTCGACGTGTTCCGGCCAGATGTACACAG<br>GAACATAACCCTGAGCCATTTCCGTGGTGGCTTAATAAGTTTGTTGTCGAGCACACATTAGACGCATGCC<br>CTCTGAGAGCAGATGACCTTATACCCACTGGAGAAGGCGAAATATTTGTTAGTCCATTCTCTGCAGAAG<br>AAGGTGACTTTCACCAGATACATGCAGACTTAAATGCAGCACAGAATCTCCAACAAAGGTTGTGGTCGG<br>ATTTTGATATTTCGCAAATAAGACTAAGATGCGATTGGGGAGAGGTTGATGGAGAATTGGTGCTGATTC<br>CAAGATTAACCGGAAAGCGAACTGCCGATTCCTATTCTAACAAGGTGTTTTACACAAATACTGGTGTTAC<br>CTATTACGAAAGAAAGGGGTAAGAAGAGACGTAAAGTATTTGCTCAAGAAAAATTGTCAGAAGAGG<br>AGGCAGAACTGTTAGTAGAAGCAGACGAAGCCAGAGAAAATCAGTTGTGCTTATGCGTGACCCTTCCG<br>GCATTATAAATCGTGGTAATTGGACACGACAAAAGAATTTTGGTCTATGGTCAATCAACGTATCGAAG<br>GCTACCTAGTTAAGCAAATCAGGTCTAGGGTTCCACTACAAGATAGCGCATGTGAAAATACGGGTGATA<br>TATAA |
| SEQ ID NO: 140 | ATGGCTACTAGATCTTTCATTTTAAAAATTGAACCTAATGAAGAAGTGAAGAAGGGTCTCTGGAAAACT<br>CACGAAGTACTTAATCATGGCATTGCCTATTATATGAATATCCTGAAGCTTATTCGTCAAGAAGCTATAT<br>ACGAGCATCATGAGCAAGATCCTAAGAACCCTAAGAAAGTAAGCAAAGCGGAAATTCAGGCTGAATTG<br>TGGGACTTCGTCTTGAAGATGCAGAAGTGTAACAGTTTTACGCACGAAGTTGATAAAGATGTGGTGTTT<br>AATATTTTGAGGGAGCTATATGAGGAGTTGGTGCCCTCGAGTGTCGAAAAAAAAGGAGAAGCTAATCAG<br>CTGTCAAATAATTTTTATATCCTCTGGTGGATCCAAACTCTCAATCAGGTAAAGGCACTGCCAGTAGTG<br>GTCGAAAACCGAGATGGTATAATTTGAAATCGCAGGTGATCCATCGTGGGAAGAAGAAAAAAAAAA<br>TGGGAAGAAGATAAAAAAAAAGATCCCCTTGCCAAAATACTAGGTAAGCTAGCCGAGTATGGACTTAT<br>ACCATTATTCATTCCTTTCACGGACTCTAATGAACCAATTGTGAAGGAAATCAAATGGATGGAAAAATC<br>ACGTAATCAGTCTGTTAGGAGGTTGGACAAAGATATGTTTATACAGGCTCTTGAGAGGTTTTTGTCGTGG<br>GAGTCCTGGAATTTGAAAGTGAAAGAAGAATATGAAAAAGTGGAAAAGGAGCATAAGACGTTGGAAGA<br>AAGGATTAAGGAAGATATTCAGGCCTTTAAGAGTCTGGAACAGTACGAAAAAGAAAGACAGGAACAGT<br>TATTGAGAGATACTCTAAACACTAATGAATATAGGCTTTCCAAGAGGGCTTGCGAGGATGGAGAGAGA<br>TAATTCAGAAATGGTTGAAAATGGATGAGAACGAGCCATCGGAGAAATATCTAGAGGTGTTTAAAGATT<br>ACCAAAGAAAGCACCCTCGCGAAGCTGGTGATTACTCTGTTTATGAATTCCTTTCGAAGAAGGAAAATC<br>ACTTCATCTGGCGAAATCATCCGAGTACCCATATTTATATGCTACATTTTGCGAAATTGACAAGAAAAA<br>AAAAGATGCTAAACAGCAAGCGACATTCACCCTCGCTGATCCCATCAACCACCCATTATGGGTCAGGTT<br>CGAAGAGAGATCAGGCTCGAACCTGAATAAGTACAGGATCTTGACTGAGCAATTGCATACTGAGAAGTT<br>AAAAAAGAAATTGACGGTCCAACTTGACAGATTGATTTATCCCACTGAATCTGGTGGATGGGAGGAGAA<br>AGGTAAGGTTGATATTGTCCTATTGCCTTCTCGTCAATTTTACAACCAAATATTTCTGGACATCGAAGAG<br>AAGGGTAAACATGCTTTTACCTATAAGGATGAGAGTATTAAATTTCCATTGAAGGGAACGCTTGGCGGC<br>GCTAGAGTTCAGTTCGATAGAGATCATTTGAGAAGATACCCGCATAAAGTGGAATCTGGTAATGTAGGT<br>CGGATCTACTTTAACATGACGGTAAATATTGAACCTACCGAGTCACCAGTCAGTAAGTCTTTAAAGATTC<br>ATAGGGATGATTTCCCTAAATTTGTCAACTTCAAGCCTAAGGAACTAACCGAGTGGATCAAAGACAGTA<br>AAGGCAAAAAGTTAAAGAGCGGTATTGAGTCCCTGGAGATAGGCTTAGAGTCATGTCTATCGATTTGG<br>GTCAAAGACAAGCAGCCGCAGCATCTATTTTCGAAGTTGTTGACCAAAAACCGGATATCGAGGGGAAAT<br>TATTTTTTCCAATAAAAGGAACTGAGCTATACGCTGTGCATCGCGCATCCTTCAATATAAAACTGCCAGG<br>AGAAACACTAGTAAAATCTAGAGAGGTCTTGCGTAAAGCACGTGAGGACAATCTCAAATTAATGAATCA<br>GAAGTTAAATTTCCTTAGGAACGTGTTGCATTTCCAACAGTTCGAGGACATAACTGAACGCGAGAAAAG<br>AGTCACTAAGTGGATCTCAAGACAAGAAAATAGTGATGTGCCATTGGTGTATCAAGACGAACTTATTCA<br>AATAAGAGAGCTAATGTATAAACCATATAAAGACTGGGTGGCATTCTTAAAACAATTACACAAGCGGCT<br>TGAAGTAGAAATAGGAAAAGAAGTAAAGCATTGGAGGAAGAGTCTGTCCGATGGTCGCAAAGGCCTGT<br>ACGGGATATCACTTAAAAATATTGATGAAATTGACAGAACACGAAAATTTTGTTAAGATGGTCATTGA<br>GACCAACCGAACCAGGTGAGGTTAGAAGGTTGGAACCAGGCCAAAGGTTTGCCATCGATCAATTAAACC<br>ATCTTAACGCACTGAAAGAAGATAGATTGAAGAAGATGGCGAACACTATTATTATGCACGCTCTAGGTT<br>ATTGCTATGATGTGAGAAAGAAAAAATGGCAAGCCAAGAACCCTGCATGCCAAATTATTTGTTTGAAG<br>ATCTTTCTAATTACAATCCATACGAAGAGCGTTCACGTTTTGAAAACTCTAAATTGATGAAATGGTCTAG<br>AAGAGAGATTCCGAGACAGGTCGCTCTACAAGGGGAGATTTACGGTCTTCAAGTCGGTGAGGTTGGTGC<br>TCAATTTTCTTCCAGATTTCATGCAAAAACTGGGTCTCCAGGCATTAGGTGTTCGGTCGTTACTAAGGAA<br>AAGTTACAGGACAACCGTTTCTTCAAAAATTTGCAACGTGAAGGCCGTTTAACACTTGATAAGATAGCT<br>GTCCTTAAGGAAGGCGATCTGTACCCAGATAAAGGTGGTGAGAAATTCATATCTTTGAGTAAAGACAGG<br>AAACTGGTTACAACACACGCCGACATTAACGCAGCTCAGACAAAAGAGATTCTGGACAAGGACC<br>CACGGCTTCTATAAGGTGTACTGTAAAGCTTATCAAGTAGATGGACAAACGGTTTATATTCCTGAATCAA<br>AGGACCAGAAACAAAAATTATAGAAGAATTTGGTGAAGGATACTTTATCTTGAAGGATGGAGTTTATG<br>AGTGGGGCAATGCAGGTAAGTTAAAGATAAAGAAAGGTTCATCAAAGCAATCAAGTAGCGAACTGGTC<br>GATTCGGATATTTTAAAGGATAGCTTTGATCTAGCTAGTGAATTGAAGGGAGAAAAGTTAATGTTATAC<br>AGAGATCCCAGTGGGAATGTATTTCCATCTGATAAGTGGATGGCCGCCGGAGTGTTTTTGGCAAATTAG<br>AGAAATCTTGATTTCTAAACTGACCAATCAATACTCAATTTCGACCATCGAAGACGACTCTTCAAAACA<br>ATCCATGTGA |
| SEQ ID NO: 141 | ATGCCTACTCGCACCATCAATCTGAAGTTAGTTTTGGGGAAGAACCCAGAAAATGCGACTCTAAGACGG<br>GCACTATTCTCTACACATAGACTTGTCAACCAAGCGACTAAGAGAATTGAAGAATTTTTACTGTTGTGTA<br>GAGGAGAAGCTTATCGTACCGTAGATAATGAAGGTAAAGAAGCTGAGATCCCACGCCATGCTGTTCAAG<br>AAGAGGCGCTTGCTTTTGCAAAAGCTGCACAACGACATAACGGCTGTATCTCCACATATGAGGACCAGG<br>AAATCTTGGATGTGCTTAGACAATTGTATGAAAGATTAGTACCTAGCGTCAATGAAAACAAGAGCCTG<br>GGGATGCCCAAGCCGCTAACGCTTGGGTGAGTCCATTAATGAGTGCAGAGTCCGAAGGTGGACTATCGG<br>TCTATGATAAAGTGTTAGACCCGCCGCCAGTATGGATGAAACTCAAAGAAGAGAAAGCGCCTGGTTGGG<br>AAGCTGCTTCTCAGATTTGGATACAGTCCGACGAAGGTCAATCGCTGCTAAATAAACCGGGTAGCCCAC<br>CACGTTGGATTAGAAAACTTAGATCTGGTCAACCGTGGCAAGATGACTTCGTTTCAGACCAAAAAAAA<br>AGCAAGATGAACTAACGAAAGGTAACGCACCACTCATAAAACAATTGAAAGAGATGGGCCTCTTGCCTT |

TABLE 5-continued

| SEQ ID NO | Sequence |
|---|---|
| | TAGTTAATCCTTTTTTAGACATTTGTTGGATCCCGAGGGTAAGGGTGTATCCCCATGGGACAGATTGGC<br>CGTAAGGGCCGCGGTGGCGCACTTCATCTCTTGGGAAAGTTGGAACCACAGAACAAGAGCTGAGTATAA<br>CAGTTTGAAACTGCGAAGAGATGAATTTGAGGCCGCATCTGATGAATTCAAGGACGATTTTACATTGCT<br>ACGACAATATGAGGCTAAGCGACATAGTACGCTTAAGTCAATTGCCTTAGCTGATGACTCTAACCCGTA<br>CCGAATTGGTGTAAGGTCCTTGAGAGCCTGGAATAGGGTTAGAGAAGAATGGATTGACAAAGGCGCAA<br>CCGAGGAACAAAGGGTTACCATCCTTAGTAAGCTTCAAACACAATTACGGGGTAAATTCGGTGATCCAG<br>ACCTATTTAATTGGCTAGCCCAAGATAGACACGTACACCTGTGGTCCCCGAGAGATTCCGTCACGCCCCT<br>CGTAAGGATTAATGCCGTCGACAAAGTGCTTAGAAGACGTAAGCCTTATGCACTGATGACTTTTGCACA<br>TCCGAGATTCCATCCAAGATGGATTCTATACGAAGCGCCTGGTGGTTCTAACTTGCGACAATACGCTTTA<br>GATTGTACTGAAAATGCTCTGCATATTACACTTCCATTACTCGTCGACGACGCCCATGGTACATGGATTG<br>AGAAAAAAATCCGCGTACCACTCGCTCCTAGTGGACAAATACAAGATTTAACTTTAGAAAAACTTGAAA<br>AGAAAAAAAACAGATTATACTATAGATCAGGATTCCAACAATTTGCTGGATTAGCCGGTGGTGCTGAGG<br>TGTTGTTTCATAGGCCGTATATGGAACATGATGAGAGATCAGAAGAATCTCTGTTGGAAAGGCCAGGCG<br>CTGTGTGGTTCAAATTAACCTTAGATGTTGCTACCCAAGCACCCACCTAACTGGTTAGATGGTAAAGGCAG<br>AGTTAGGACACCTCCAGAAGTTCATCATTTCAAAACCGCTCTGTCAAATAAATCTAAACATACGAGAAC<br>CTTGCAACCAGGATTGAGAGTCCTTTCTGTTGATTTGGGTATGAGAACATTTGCTTCTTGTTCTGTTTCG<br>AATTGATCGAAGGTAAACCTGAAACAGGTAGAGCATTCCCTGTTGCTGACGAAAGATCAATGGATAGTC<br>CAAATAAGTTATGGGCCAAGCACGAGAGAAGCTTTAAACTAACTCTGCCTGGAGAAACACCGAGCAGA<br>AAGGAGGAAGAAGAGAGAAGCATTGCTAGGGCAGAGATTTACGCGCTGAAAAGAGATATTCAAAGACT<br>GAAATCACTCCTAAGATTAGGTGAGGAAGATAATGATAATAGAAGAGATGCTTTGTTAGAGCAATTCTT<br>TAAAGGATGGGGTGAAGAGGACGTAGTTCCTGGTCAAGCTTTCCCTAGAAGCCTCTTTCAGGGATTAGG<br>CGCTGCACCCTTTAGGTCAACACCCGAATTGTGGAGACAGCACTGTCAGACGTATTACGACAAAGCGGA<br>AGCTTGCCTGGCAAAGCATATTTCCGACTGGAGGAAGAGAACTAGACCTCGTCCGACTTCGAGAGAGAT<br>GTGGTATAAGACAAGATCTTACCATGGTGGCAAAAGTATTTGGATGCTAGAATACTTAGATGCTGTCCG<br>CAAATTACTACTTTCATGGTCGTTAAGAGGTCGTACTTACGGAGCTATTAATAGACAAGACACCGCTCGT<br>TTTGGTTCCTTAGCTTCTAGATTGTTGCATCATATCAACTCTTTAAAGGAAGACCGCATCAAAACCGGTG<br>CAGATAGTATTGTGCAGGCCGCAAGGGGCTATATTCCTCTCCCACATGGCAAGGGTTGGGAACAGCGTT<br>ATGAACCCTGTCAGTTGATATATTTGAAGATCTAGCTAGGTACAGATTTCGTGTAGACAGACCTCGGAG<br>AGAGAATTCGCAATTGATGCAGTGGAATCATCGAGCTATAGTAGCAGAAACGACGATGCAAGCTGAACT<br>ATACGGTCAAATAGTCGAAAATACCGCTGCTGGTTTCTCCTCAAGATTTCATGCTGCAACTGGTGCTCCT<br>GGTGTCAGATGTCGCTTTTTGTTAGAACGAGATTTCGATAATGACCTACCAAAGCCGTACTTACTGAGAG<br>AACTAAGTTGGATGTTAGGTAACACAAAGGTTGAATCAGAGGAAGAAAAATTGCGTCTTCTAAGCGAGA<br>AAATTAGACCAGGTTCATTAGTCCCTTGGGATGGGGTGAACAATTCGCGACATTACACCCGAAAAGAC<br>AAACTCTTTGTGTCATTCACGCAGATATGAACGCTGCTCAAAACCTGCAACGCAGATTTTTCGGAAGGTG<br>TGGGGAAGCCTTTCGCCTTGTGTGTCAGCCACATGGTGATGATGTTTTGAGGCTAGCGTCTACACCAGGT<br>GCAAGACTTTTGGGTGCATTACAACAACTGGAAAATGGTCAGGGAGCTTTCGAATTAGTTCGTGATATG<br>GGTAGCACATCACAAATGAATCGTTTCGTCATGAAGTCGTTGGGCAAAAAAAGATCAAGCCATTACAA<br>GACAATAACGGGGATGATGAACTAGAAGACGTGCTATCTGTTTTTACCTGAAGAAGATGATACCGGACGA<br>ATTACTGTATTTCGGGACTCTTCGGGTATATTCTTCCCTTGTAACGTTTGGATCCCGGCAAAACAGTTCTG<br>GCCTGCGGTCCGTGCTATGATTTGGAAGGTTATGGCATCACATTCATTGGGTTAG |
| SEQ ID NO: 142 | ATGACAAAGTTAAGGCATAGACAGAAGAAGTTAACTCACGATTGGGCGGGGTCTAAAAAGAGAGAAGT<br>TCTAGGGAGCAATGGTAAATTACAGAATCCATTGCTAATGCCCGTCAAAAAGGTCAGGTGACAGAATT<br>TCGAAAAGCATTTTCCGCATACGCCCGAGCAACCAAAGGGGAAATGACGGATGGCAGAAAAATATGT<br>TTACTCACTCATTTGAACCATTCAAGACCAAGCCTTCGTTACATCAGTGCGAACTGGCTGACAAAGCCTA<br>CCAGAGCTTGCATTCATATTTACCGGGTTCTTTGGCGCATTTTCTTTTATCTGCCCATGCACTTGGTTTTA<br>GGATTTTTAGCAAATCAGGGGAAGCCACTGCATTCCAAGCGTCCTCAAAGATTGAAGCTTACGAAAGCA<br>AGTTAGCTAGCGAGCTTGCTTGTGTTGATTTGTCTATTCAGAACTTGACTATTTCAACTTTGTTCAACGCA<br>TTAACGACTTCCGTAAGAGGTAAAGGTGAGGAGACATCGGCAGATCCACTGATAGCTAGATTTTACACC<br>TTACTTACCGGTAAACCACTAAGCAGAGCACTCAGGGCCCAGAACGAGATTTAGCCGAGGTGATAAGC<br>AGAAAAATTGCAAGTTCTTTTGGAACTTGGAAGGAGATGACTGCCAATCCACTTCAATCTCTTCAATTTT<br>TTGAAGAGGAGTTGCATGCGCTAGATGCAAATGTTAGTTTGTCACCTGCCTTCGATGTTCTGATTAAGAT<br>GAACGACCTGCAGGGTGACTTGAAGAACAGAACGATAGTTTTTGATCCAGATGCTCCTGTGTTTGAATA<br>TAATGCTGAGGATCCTGCTGACATCATCATTAAACTGACAGCTAGATAGCGAAAGAAGCAGTGATTAA<br>AAATCAAAATGTCGGGAATTATGTTAAGAACGCTATTACGACAACTAACGCAAACGGACTAGGTTGGTT<br>GCTGAACAAAGGCCTTTCCTTATTGCCTGTCTCCACTGATGACGAACTATTGGAGTTTATTGGGGTCGAG<br>AGATCCCATCCTAGCTGTCATGCGTTGATAGAACTTATCGCTCAGTTAGAAGCACCTGAACTGTTCGAAA<br>AAAATGTTTTTTCTGATACTCGTTCCGAGGTTCAAGGTATGATAGATTCAGCTGTGAAGCAATCATATCGC<br>CAGGCTGTCAAGCTCTCGTAATTCATTGAGCATGGACTAGCAGAGGAACTTGAGAGATTGATAAAATCTTT<br>CAAATTCATACACCACATTGTTCATTATTTATAGGGGCTCAATCCTTATCTCAACAATTGGAAAGCCTAC<br>CCGAAGCATTGCAGTCAGGAGTGAACAGTGCTGATATTCTGCTCGGCTCAACCCAATACATGTTGACAA<br>ATTCTTTGGTCGAGGAGTCAATCGCTACGTATCAGAGAACCTTAAATAGAATTAACTACCTGTCCGGCGT<br>TGCAGGACAGATTAACGGTGCTATTAAGAGGAAAGCTATTGATGCTAAAACATTTACCCGCTGC<br>TTGGTCAGAGTTAATTTCTTTACCCTTTATTGGGCAACCAGTGATTGATGTTGAATCAGATTTAGCCCACT<br>TAAAGAACCAATACCAGACATTGTCTAACGAATTTGATACGCTGATTTCCGCACTGCAAAAGAATTTCG<br>ACTTAAATTTTAATAAAGCCTTGCTTAATCGAACACAACATTTCGAGGCTATGTGTAGATCAACAAAAA<br>AGAATGCCCTTTCTAAGCCTGAGATCGTTAGTTATAGAGATTTGCTAGCCAGGTTGACTTCTTGTCTTTAT<br>AGGGGCTCTCTAGTCTTGAGGAGGCGGGTATAGAAGTACTGAAAAAGCACAAGATATTTGAGTCCAAC<br>TCTGAATTAAGAGAGCACGTTCATGAAAGAAAACACTTCGTATTTGTTTCTCCGCTCGATAGAAAGCC<br>AAGAAGCTCCTACGTTTGACTGACTCTAGGCCTGATTTATTGCACGTAATTGATGAAATACTACAACATG<br>ATAATTTAGAGAACAAGGATAGAGATCTTTGTGGTTAGTTGATCTTGGTTATTTACTGGCCGGCCTACC<br>AGACCAACTCTCCTCTTCCTTTATAAATCTTCCAATCATTACTCAAAAGGCGATCGTCGCTTGATAGAT<br>CTCATTCAATACGACCAAATTAATAGAGATGCTTTTGTGATGTTGGTAACTTCCGCTTTTAAGTCGAACT<br>TAAGTGGGCTGCAGTACAGAGCAAACAAACAATCTTTTGTGGTTACGCGCACTTTGTCACCATATTTGGG<br>ATCTAAATTGGTTTATGTGCCCAAAGATAAAGATTGGCTGGTCCCTTCCCAAATGTTCGAGGGGAGATTT<br>GCGGACATTTTGCAATCCGATTATATGGTGTGGAAGGACGCTGGAAGATTGTGTGTTATTGACACAGCT |

TABLE 5-continued

| SEQ ID NO | Sequence |
|---|---|
| | AAGCATTTGTCTAACATTAAAAAATCTGTATTCTCAAGTGAAGAAGTCCTCGCGTTTTTAAGAGAATTGC<br>CACACCGTACGTTTATCCAAACTGAGGTCAGGGGTTTAGGGGTGAATGTGGACGGTATTGCATTTAATA<br>ACGGGGATATACCCTCTCTGAAGACGTTTAGCAATTGCGTGCAAGTCAAAGTGAGTCGGACAAACACTA<br>GTCTGGTCCAAACATTAAATAGATGGTTTGAAGGCGGTAAGGTCTCGCCGCCTAGCATCCAATTTGAGA<br>GAGCATATTACAAAAAAGATGATCAAATCCACGAGGACGCTGCAAAAAGGAAGATAAGGTTTCAAATG<br>CCAGCTACAGAGTTGGTACACGCGTCAGACGACGCAGGATGGACCCCCTCCTATTTACTTGGTATCGATC<br>CCGGTGAATATGGTATGGGTTTGTCATTGGTCTCAATAAATAATGGCGAAGTTTTAGATAGCGGATTTAT<br>ACACATAAATTCATTGATAAATTTCGCTTCTAAGAAATCAAATCATCAAACCAAAGTTGTTCCGAGGCA<br>GCAATACAAGTCACCATACGCCAACTATCTAGAACAATCTAAAGATTCTGCAGCAGGAGACATAGCTCA<br>TATTTTGGATAGACTTATCTACAAGTTGAACGCCCTACCCGTTTTCGAAGCTCTATCTGGCAATAGTCAA<br>AGCGCAGCGGATCAGGTTTGGACAAAAGTCCTCAGCTTCTACACCTGGGGAGATAATGATGCACAAAAT<br>TCAATTCGTAAGCAACATTGGTTCGGTGCTTCACACTGGGACATTAAAGGCATGTTGAGGCAACCGCCA<br>ACAGAAAAAAAGCCCAAACCATACATTGCCTTTCCCGGTTCACAAGTTTCTTCTTATGGTAATTCTCAAA<br>GGTGTTCATGTTGTGGACGTAACCCAATTGAACAATTGCGCGAAATGGCGAAGGACACATCCATTAAGG<br>AGTTGAAGATTAGAAATTCAGAAATTCAATTGTTCGACGGTACTATAAAGTTATTTAATCCAGACCCGTC<br>AACGGTCATAGAAAGAAGAAGACATAATTTAGGGCCATCAAGAATTCCTGTAGCTGATAGAACTTTCAA<br>AAATATAAGTCCAAGCTCACTAGAATTCAAAGAACTAATAACGTGTGTCACGGTCTATACGTCATTCC<br>CCAGAATTTATTGCTAAAAAAGAGGTATAGGTAGTGAGTACTTTTGTGCTTATAGTGATTGTAATTCCT<br>CCTTAAATTCAGAAGCAAATGCGGCTGCGAACGTTGCCCAAAAGTTCCAAAAGCAATTGTTTTTCGAATT<br>ATAG |
| SEQ ID NO: 143 | ATGAAAAGAATCTTGAACTCTTTAAAGGTTGCCGCCCTGCGTTTGTTATTTAGAGGTAAAGGATCTGAAC<br>TTGTCAAGACTGTTAAATACCCTTTGGTCTCGCCGGTTCAGGGTGCAGTTGAGGAGTTAGCTGAGGCGAT<br>CCGCCATGATAACCTACATCTGTTTGGTCAAAAAGAAATTGTTGACCTTATGGAAAAGGATGAAGGTAC<br>GCAAGTTTACTCAGTGGTTGATTTCTGGTTAGATACCCCTTCGTTTGGGGATGTTTTTCAGTCCATCAGCAA<br>ACGCATTAAAAATCACGCTGGGTAAGTTTAATTCTGATCAGGTTAGCCCTTTTAGGAAAGTGTTAGAGCA<br>GTCTCCATTCTTCTTGGCTGGTAGGCTGAAGGTTGAACCGGCAGAAGTGTATATTATCTGTCGAGATCCGT<br>AAGATTGGGAAGAGGGAAAACAGAGTTGAGAACTATGCTGCTGACGTAGAAACGTGTTTTATAGGCCA<br>ATTAAGTTCAGATGAGAAACAGTCAATACAAAAATTAGCTATGATATCTGGGATAGTAAAGATCATGA<br>AGAGCAAAGAATGTTAAAGGCAGATTTCTTCGCTATCCCTTTGATTAAGGATCCAAAGGCTGTGACCGA<br>AGAGGATCCTGAAAATGAAACTGCTGGTAAACAAAAACCCTTGGAGTTGTGTGTCTGCCTTGTCCCAGA<br>ACTTTACACAAGAGGATTCGGTCAATAGCCGATTTTTTGGTTCAACGCTTAACTCTTTTAAGGGATAAA<br>ATGTCTACAGATACTGCAGAAGATTGTTTAGAATATGTCGGGATTGAGGAGGAAAAAGGTAACGGCATG<br>AACTCATTGTTGGGAACGTTCTTAAAGAATTTGCAAGGCGATGGATTTGAGCAGATTTTCCAATTTATGT<br>TAGGGAGCTATGTCGGTTGGCAAGGGAAGGAAGATGTTTAAGAGAGAGATTAGACTTATTGGCTGAAA<br>AAGTGAAGAGGTTACCGAAACCAAAATTTGCTGGCAATGGTCTGGTCATAGGATGTTCTTGCATGGCC<br>AATTGAAGTCTTGGTCTTCAAATTTTTTTAGACTATTTAACGAGACAAGGGAACTTCTAGAGTCTATTAA<br>GTCAGATATACAGCATGCCACAATGTCTAATATCATATGTAGAAGAAAAAGGTGGTTATCATCCTCAATT<br>ACTTAGTCAATATAGAAAACTTATGGAACAACTACCAGCTTTGCGTACCAAGGTATTGGACCCTGAGAT<br>TGAAATGACACATATGTCCGAAGCAGTTCGCTCTTATATAATGATACATAAATCTGTTGCGGGTTTTTA<br>CCGGATTTATTAGAATCATTAGATAGAGACAAGGATCGTGAGTTTCTGCTTAGTATTTTTCCAAGAATCC<br>CAAAATTGATAAAAAAACCAAGGAAATTGTAGCTTGGGAACTGCCGGGAGAACCAGAAGAAGGTTAT<br>TTATTTACTGCTAATAACTTGTTCAGAAACTTCTTAGAGAATCCGAAACATGTCCCGAGATTATGGCCG<br>AAAGGATCCCAGAAGATTGGACTCGATTACGCTCTGCTCCTGTCTGGTTCGATGGAATGGTAAAACAAT<br>GGCAAAAAGTCGTTAACCAGTTAGTAGAATCACCAGGTGCTTTATATCAATTTAACGAATCCTTCTTGAG<br>ACAAAGGTTACAGGCCATGTTAACTGTGTATAAGAGGGACTTACAAACTGAAAAATTTCTTAAACTTTT<br>GGCCGATGTTTGTAGGCCTCTTGTAGATTTTTTTGGTTTGGGTGGAAATGATATTATTTTTAAGAGCTGTC<br>AAGACCCAAGAAACAATGGCAAACCGTTATTCCTCTCTCTGTTCCGGCAGATGTCTATACTGCTTGCGA<br>AGGTTTGGCGATTAGACTAAGGGAGACATTAGGATTCGAATGGAAGAATTTGAAAGGTCACGAGAGAG<br>AAGATTTCTTAAGATTGCACCAGTTATTGGGCAATTTACTTTTCTGGATTCGTGATGCTAAATTGGTAGT<br>AAAATTAGAGGATTGGATGAACAACCCATGTGTTCAGGAATATGTAGAAGCCCGGAAAGCTATCGATCT<br>TCCACTAGAAATATTCGGTTTTGAAGTGCCTATCTTCCTGAATGGCTATCTATTTTCGGAGTTGAGACAA<br>TTAGAACTTTTGCTTAGGAGAAAAAGTGTGATGACTAGCTACAGTTGAAAGACTACTGGATCTCCTAAT<br>AGGCTATTTCAGCTAGTTTATTTACCTCTAAACCCTAGTGACCCCGAAAAGAAGAACTCAAATAACTTTC<br>AAGAACGTTTGGATACCCCAACTGGTTTGTCCCGTCGTTTCCTAGACCTAACCCTTGATGCATTCGCAGG<br>TAAGTTACTTACCGATCCAGTTACACAAGAATTGAAGACAATGGCAGGTTTTTACGATCATCTTTTTGGA<br>TTCAAATTGCCATGTAAACTCGCCGCCATGTCGAATCATCCAGGTTCTTCTTCAAAGATGGTTGTGTTAG<br>CGAAACCCAAAAAAGGTGTTGCTTCTAATATAGGGTTTGAACCGATCCGAAGAAGGTGTTCTTCCTGTATT<br>TAGGGTTAGATCCAGTTGGCCAGAGTTGAAGTACCTCGAGGGGCTATTGTATTTGCCAGAAGACACACC<br>TTTGACCATCGAATTAGCAGAGACCTCCGTATCGTGCCAAAGTGTCTCGTCAGTTGCATTCGATTTGAAA<br>AACTTGACAACGATCTTAGGTCGTGTGGGAGAATTTAGGGTCACAGCTGATCAACCCTTTAAACTAACG<br>CCTATAATCCCGGAGAAAGAAGAATCTTTTATTGGTAAAACTTATTTGGGTCTCGACGCGGGTGAAAGG<br>AGCGGCGTCGGTTTCGCTATTGTTACAGTGGACGGAGATGGGTACGAAGTGCAAAGATTGGGGGTCCAC<br>GAGGATACACAGCTTATGGCCTTGCAGCAAGTTGCTAGTAAATCCTTAAAAGAGCCAGTATTTCAGCCT<br>CTAAGAAAGGCACCTTTAGACAACAAGAAAGAATACGAAATCCTTACGTGGTTGCTACTGGAATTTT<br>TATCATGCCTTGATGATAAAATATAGGGCCAAAGTAGTACATGAGGAATCTGTCGGAAGTAGTGGTCTT<br>GTGGGTCAATGGTTGAGGGCTTTTCAGAAGGATTTGAAGAAAGCCGATGTTCTCCCCAAGAAGGGCGGT<br>AAAAACGGTGTAGATAAGAAGAAGAGGTCCTCAGCTCAAGACACTCTTTGGGGTGGTGCTTTCTCT<br>AAAAAGGAGGAGCAACAGATTGCGTTTGAGGTGCAAGCTGCAGGTTCTTCGCAATTTTGTTTGAAGTGC<br>GGATGGTGGTTCCAACTAGGCATGCGTGAAGTAAACAGGGTACAAGAATCGGGCGTCGTGTTAGATTGG<br>AATAGAAGCATAGTTACCTTTTTAATAGAATCATCCGGCGAAAAAGTTTATGGTTTCTCCCCACAGCAAT<br>TAGAGAAGGGTTTCAGACCAGACATCGAAACTTTTAAAAAGATGGTAAGAGACTTTATGAGACCTCCTA<br>TGTTTGATAGAAAGGCAGACCGGCCGCAGCTTACGAGAGATTTGTTTAGGAAGGAGACATCGAAGGT<br>ACAGGTTTGATAAAGTATTTGAGGAAAGATTTGGGAGGTCTGCTCTTTTCATTTGTCCTAGAGTAGGTTG |

TABLE 5-continued

| SEQ ID NO | Sequence |
|---|---|
| | TGGAAATTTTGACCACAGCTCCGAACAGTCCGCGGTTGTTTTGGCCTTGATCGGATATATTGCCGATAAG<br>GAGGGAATGTCAGGTAAGAAGTTGGTTTATGTACGGCTGGCCGAACTTATGGCCGAATGGAAACTAAAA<br>AAATTAGAAAGATCCAGAGTTGAAGAACAATCATCCGCTCAATAA |
| SEQ ID NO: 144 | ATGGCAGAAAGCAAACAAATGCAGTGTAGGAAATGTGGAGCTAGTATGAAGTACGAAGTCATCGGTTT<br>GGGTAAAAAGTCATGTAGATACATGTGTCCCGATTGTGGCAACCATACCTCGGCAAGAAAGATACAAAA<br>CAAAAAAAAAGAGATAAAAAATATGGGTCAGCCAGTAAAGCCCAATCTCAAAGAATTGCTGTAGCAG<br>GTGCTCTTTACCCTGACAAAAAGTACAAACTATCAAAACCTATAAATATCCAGCAGACTTGAATGGTG<br>AGGTGCATGATAGCGGTGTTGCCGAGAAAATCGCACAAGCAATACAAGAGGACGAGATTGGACTTTTG<br>GGACCAAGCTCAGAATATGCATGCTGGATTGCATCTCAAAAACAGTCTGAGCCTTACAGTGTAGTCGAT<br>TTCTGGTTTGATGCAGTGTGCGCAGGGGGAGTCTTCGCCTACTCTGGCGCTAGATTATTGAGTACAGTTT<br>TACAGTTATCCGGTGAGGAATCGGTGCTTAGAGCTGCCTTAGCCTCGTCTCCATTCGTTGACGATATAAA<br>CTTAGCGCAAGCCGAAAAGTTTTTGGCGGTTAGCAGGCGTACAGGTCAAGATAAGTTAGGTAAGAGAAT<br>TGGGGAGTGCTTTGCAGAAGGAAGATTGGAAGCTTTAGGGATAAAAGATAGAATGAGGGAATTGTTCA<br>AGCTATCGATGTTGCACAGACCGCCGGACAACGTTTCGCTGCCAAATTGAGATATTCGGTATAAGTCA<br>GATGCCAGAAGCTAAGCAATGGAATAACGATTCCGGACTGACTGTCTGTATACTACCTGATTATTATGTT<br>CCCGAAGAGAATCGCGCGGACCAACTTGTAGTGTTGTTAAGAACATTCGCGAGATTGCATATTGCATG<br>GGTATTGAAGATGAAGCGGGTTTCGAACATCTTGGAATAGATCCTGGTGCTCTTTCGAATTTTTCAAACG<br>GTAACCCTAAGAGAGGATTTCTAGGGAGGCTGTTAAATAACGATATTATTGCGTTGGCAAACAATATGA<br>GTGCGATGACTCCATATTGGGAAGGGCGTAAGGGTGAACTCATAGAAAGGCTTGCGTGGTTAAAGCACA<br>GGGCAGAAGGGCTGTATCTTAAAGAACCTCATTTCGGTAACTCCTGGGCCGATCATAGGTCACGAATTTT<br>CTCAAGGATCGCAGGCTGGTTATCTGGTTGCGCGTGGCAAGTTGAAAATTGCGAAAGACCCAAATTTCTGG<br>AGTACGTACAGATCTATTTCTGCTAAAAAGACTGCTGGACGCAGTTCCGCAATCGGCGCCATCCCCCGAT<br>TTTATTGCGTCAATTTCGGCACTTGACAGGTTTTTAGAAGCTGCAGAATCGAGCCAGGACCCTGCTGAAC<br>AAGTGAGGGCTCTCTACGCTTTTCACTTGAACGCACCTGCAGTCGCAAGTATAGCCAATAAAGCAGTGC<br>AAAGGTCCGACAGCCAAGAATGGCTGATAAAAGAACTAGACGCTGTTGACCATTTAGAATTTAACAAAG<br>CGTTCCCATTTTTCTCTGACACAGGAAAAAAAAAAAAAAAAAGGTGCTAATAGCAACGGTGCTCCATCGG<br>AAGAAGAGTACACTGAAACGGAATCAATACAACAACCTGAGGACGCGGAACAGGAAGTAAACGGACA<br>AGAAGGGAACGGAGCGTCTAAAAATCAAAAGAAATTTCAAAGAATACCTAGATTCTTCGGTGAAGGCT<br>CCAGATCTGAATACAGAATTTTAACGGAAGCTCCACAGTATTTCGATATGTTTTGTAATAACATGAGGGC<br>TATATTTATGCAGTTAGAAAGTCAACCCCGTAAAGCTCCCAGAGATTTTAAATGTTTCCTACAAAATCGA<br>TTACAAAAATTATACAAACAGACTTTCTTGAATGCACGAAGCAACAAGTGTCGCGCTCTGCTTGAGTCA<br>GTTTTAATCTCTTGGGGAGAATTTTATACATACGGTGCCAACGAAAAGAAATTTAGATTAAGACATGAA<br>GCTTCAGAACGCAGCAGTGACCCAGATTACGTAGTTCAGCAAGCCTTGGAAATCGCGTCGTCTATTC<br>CTTTTTGGCTTCGAATGGAGAGATTGCTCCGCTGGTGAAAGAGTGGATTTGGTTGAAATTCACAAAAAG<br>GCTATCAGTTTTTTGTTGGCTATTACTCAAGCTGAGGTCTCTGTTGGTTCATACAATTGGCTTGGCAACTC<br>AACAGTATCGAGATATTTATCCGTTGCGGGAACTGATACCTTATACGGTACCCAATTGGAAGAATTCCTG<br>AACGCTACAGTGTTGAGTCAAATGCGTGGTCTGGCCATTAGATTGAGTTCTCAAGAACTTAAGGACGGT<br>TTTGATGTGCAGCTCGAGTCTTCCTGCCAGGACAATCTGCAACACCTATTGGTGTATAGGGCTTCGAGAG<br>ATTTGGCGGCTTGCAAGCGCGCTACTTGTCCAGCCGAACTCGATCCTAAGATTTTAGTTTTACCGGTAGG<br>TGCATTCATCGCTTCCGTAATGAAATGATAGAAAGAGGTGACGAACCTTTAGCTGGTGCTTATTTACGG<br>CATAGGCCACACTCTTTCGGATGGCAAATTAGGGTCCGCGGTGTTGCTGAGGTAGGGATGGATCAGGGT<br>ACAGCATTGGCCTTTCAAAAGCCAACAGAGTCAGAACCTTTTAAAATTAAGCCCTTCTCTGCACAGTATG<br>GACCAGTTCTGTGGTTGAACAGTAGTAGTTATTCTCAATCACAATATTTGGACGGTTTTCTATCTCAACC<br>AAAAAAATTGGAGTATGAGGGTGTTGCCTCAGGCGGGTTCAGTTCGCGTCGAACAACGAGTTGCTTTGAT<br>ATGGAACTTACAAGCAGGCAAGATGAGACTAGAACGCTCCGGTGCGAGGGCCTTTTTCATGCCTGTACC<br>GTTTTCATTTAGGCCATCCGGCAGTGGGGACGAAGCAGTTTTGGCGCCCAACCGGTACTTGGGTCTGTTC<br>CCTCATTCCGGAGGTATAGAATACGCTGTAGTGGATGTCCTGGATTCTGCTGGATTTAAAATTCTTGAAA<br>GAGGCACTATTGCTGTCAATGGTTTCTCTCAGAAAAGGGGAGAGCGCCAAGAAGAAGCCCATCGTGAAA<br>AACAAAGAAGGGGATAAGTGATATAGGCGAAAGAAGCCTGTGCAGGCAGAAGTCGATGCGGCGAA<br>CGAATTGCATAGAAAGTACACTGATGTTGCCACAAGATTAGGTTGTAGAATCGTCGTTCAATGGGCACC<br>ACAACCCTAAACCAGGGACAGCACCGACAGCGCAAACTGTTTACGCGAGGGCTGTTAGGACAGAAGCTC<br>CGAGGAGCGGCAACCAAGAAGATCATGCAAGAATGAAAAGTTCTTGGGGTTACACCTGGGGTACGTATT<br>GGGAGAAACGAAAACCAGAAGATATTTTAGGGATTTCTACACAGGTGTATTGGACAGGAGGTATAGGC<br>GAATCCTGTCCTGCTGTAGCAGTCGCTTTATTAGGTCATATTAGAGCAACTTCAACACAAACGGAGTGGG<br>AAAAGGAAGAAGTTGTCTTTGGAAGACTGAAGAAGTTCTTTCCGAGTTAA |
| SEQ ID NO: 145 | ATGGAGAAGAGAATTAATAAGATACGGAAAAAATTATCTGCGGATAATGCAACAAAGCCAGTCTCTCGT<br>TCAGGCCCCATGAAAACCCTGCTTGTAAGAGTAATGACGGATGATTTAAAAAAGAGGTTGGAAAAGCGT<br>AGAAAAAAACCAGAAGTGATGCCGCAAGTGATCTCAAATAACGCAGCTAATAATCTAAGGATGCTACTT<br>GATGATTATACAAAAATGAAGAAGCAATCCTGCAAGTTTACTGGCAGGAATTCAAGGATGACCATGTT<br>GGACTAATGTGCAAATTCGCACAACCAGCGTCTAAGAAAATTGACCAAAATAAATTGAAACCCGAAATG<br>GACGAAAAAGGGAATTTAACAACTGCCGGGTTTGCCTGCTCGCAATGTGGGCAACCATTATTTGTTATA<br>AATTAGAGCAGGTTTCGGAAAAAGGAAAGGCTTACACAAATTACTTCGGCAGATGTAATGTTGCCGAAC<br>ACGAAAAACTCATATTGTTAGCTCAGTTGAAGCCTGAGAAAGACTCTGATGAGGCCGTTACTTACTCGTT<br>GGGGAAGTTTGGTCAAAGAGCTCTCGATTTTTATTCTATTCATGTGACAAAGGAGTCCACACATCCCGTC<br>AAGCCCTTGGCACAAATTGCGGGTAATAGATACGCTTCGGGTCCAGTTGGGAAGGCCCTTTCTGATGCA<br>TGTATGGGCACAATTGCTAGCTTTCTTAGTAAATACCAGGATATCATAATAGAGCATCAAAAAGTTGTA<br>AAGGGTAACCAAAAGAGATTAGAATCGCTGCGTGAGTTGGCGGGTAAAGAAAACTTGGAATATCCATCT<br>GTCACTCTGCCTCCTCAACCTCATACTAAGGAAGGTGTAGATGCGTACAATGAAGTTATCGCTAGAGTCC<br>GTATGTGGGTGAATTTAAATTTGTGCAAAAATTGAAGTTATCGCTGGATGATGCAAAACCTCTTCTTAG<br>ACTAAAGGGCTTTCCTAGCTTCCCTGTAGTGGAAAGACGCGAAAATGAAGTCGATTGGTGAATACAAT<br>TAACGAAGTCAAAAACTGATCGATGCAAAGCGAGATATGGGTCGAGTTTTTTGGTCTGGTGTTACAGC<br>TGAAAAAAGGAATACGATCTTAGAAGGTTACAACTACTTGCCAAATGAGAACGATCATAAAAAAAGAG<br>AAGGCAGTTTAGAAAATCCAAAAAAGCCAGCTAAGACAATTTGGTGATTGCTACTTTACCTAGAAA<br>AAAAGTACGCCGGAGATTGGGGGAAAGTCTTTGACGAAGCTTGGGAGAGAATAGATAAAAAAATAGCA |

| SEQ ID NO | Sequence |
|---|---|
| | GGATTGACGTCACACATTGAAAGAGAAGAGGCGAGAAATGCAGAAGATGCTCAGTCCAAAGCTGTCCT<br>CACCGACTGGTTGAGAGCCAAAGCGTCCTTTGTTCTCGAACGCCTAAAAGAAATGGATGAGAAGGAATT<br>TTATGCCTGCGAAATCCAGCTACAAAAATGGTACGGAGACTTGAGAGGTAACCCCTTTGCCGTGGAAGC<br>AGAGAACCGTGTTGTAGATATCTCCGGTTTCTCAATCGGTAGCGATGGACACTCCATTCAGTATCGCAAC<br>TTGTTGGCCTGGAAATATTTGGAAAACGGTAAGAGGGAATTCTATTTACTTATGAATTATGGCAAGAAA<br>GGTAGAATCAGGTTTACTGACGGAACAGACATTAAAAGAGTGGTAAGTGGCAAGGCCTTTTGTACGGT<br>GGTGGCAAGGCCAAAGTAATAGACTTAACATTTGACCCCGACGACGAACAACTGATAATACTGCCTTTA<br>GCTTTTGGTACTCGACAGGGGCGAGAGTTCATTTGGAATGATCTTTTGTCACTCGAGACTGGTTTGATAA<br>AACTTGCAAATGGAAGAGTCATCGAGAAGACAATTTACAACAAAAAGATAGGTCGCGATGAGCCTGCA<br>CTATTTGTGGCCTTGACCTTTGAGAAGGGAAGTTGTCGACCCATCCAATATTAAACCAGTCAACCTAA<br>TCGGTGTAGATAGAGGTGAAAACATCCCAGCTGTTATCGCTCTGACAGACCCTGAAGGTTGCCCTTTGCC<br>AGAATTTAAAGATTCGTCTGGTGACCAACAGATATATTACGTATTGGGAAGGCTATAAAGAGAAACA<br>ACGTGCTATTCAGGCTGCAAAAGAAGTTGAACAGAGGAGAGCTGGAGGTTACAGTAGAAAATTCGCCA<br>GTAAAAGTAGAAACTTAGCAGATGACATGGTTAGAAACTCTGCCCGGGATTTGTTCTATCATGCGGTTA<br>CTCACGATGCAGTCTTAGTCTTTGAAAATCTATCGCGCGGTTTTGGTAGGCAAGGCAAGAGGACTTTTAT<br>GACAGAGAGACAATATACAAAAATGGAAGATTGGTTAACCGCGAAGCTCGCATATGAAGGTCTTACTTC<br>GAAAACGTACCTCAGCAAAACGCTGGCTCAATATACTTCTAAAACTTGTTCAAATTGTGGTTTTACTATT<br>ACCACGGCAGACTACGACGGGATGTTGGTGAGATTGAAGAAGACGAGCGATGGTTGGGCAACAACATT<br>GAATAATAAGGAATTAAAAGCAGAAGGACAGATTACGTATTACAATCGTTATAAACGCCAAACGGTTG<br>AGAAAGAGTTGTCAGCCGAGTTGGATAGACTAAGTGAAGAGAGCGGTAACAATGATATCTCAAAGTGG<br>ACTAAAGGGAGGCGGGATGAAGCCCTCTTTTTACTAAAGAAGAATTCTCACATAGACCTGTGCAAGAA<br>CAATTCGTTTGTTTAGATTGTGGCCATGAGGTTCATGCAGACGAACAGGCTGCGTTAAATATTGCGAGAA<br>GCTGGCTATTTCTAAATTCTAATTCAACAGAGTTCAAGAGCTATAAATCCGGAAAACAACCTTTCGTAGG<br>CGCGTGGCAAGCCTTCTATAAAAGGAGATTAAAAGAGGTTTGGAAACCAAATGCA |
| 146 | ATGAAAAGAATTAACAAAATTAGAAGGAGGCTGGTCAAAGATTCTAATACCAAGAAAGCTGGTAAGAC<br>TGGTCCGATGAAAACCCTATTAGTCAGAGTTATGACCCCAGATTTGAGAGAAAGATTGGAGAACCTCAG<br>GAAAAAGCCCGAAAACATCCCACAACCCATTAGTAACACATCAAGAGCTAATTTAAACAAGTTATTAAC<br>TGACTACACTGAAATGAAAAAAGCAATATTGCATGTTTACTGGGAAGAGTTCCAGAAAGATCCTGTTGG<br>GTTGATGTCTAGAGTTGCTCAACCGGCCCCAAAGAATATAGATCAAAGGAAACTTATTCCTGTGAAGGA<br>CGGCAATGAAAGATTAACCAGCTCCGGTTTCGCTTGCTCCCAGTGCTGCCAACCCCTGTATGTATACAAA<br>CTGGAACAAGTAAATGATAAAGGTAAGCCACATACTAACTACTTTGGTAGGTGTAATGTATCCGAGCAT<br>GAAAGATTGATCTTGTTAAGTCCCCATAAACCAGAAGCTAATGATGAGTTAGTAACTTATAGTTTAGGTA<br>AGTTCGGACAACGAGCTTTAGATTTCTATAGCATCCATGTTACAAGAGAAAGCAATCACCCCGTCAAAC<br>CACTGGAACAAATCGGTGGTAATAGTTGTGCGTCAGGTCCAGTAGGCAAAGCTTTATCAGACGCTTGCA<br>TGGGTGCCGTGGCTAGTTTTTGACGAAATACCAAGATATTATACTGGAACATCAAAAGGTAATTAAAA<br>AGAATGAAAAGAGACTCGCTAACTTAAAAGATATTGCAAGTGCCAATGGTTTAGCTTTTCCTAAAATTA<br>CCTTGCCACCTCAGCCACATACAAAGGAGGGAATTGAAGCTTACAATAATGTAGTAGCCCAAATAGTTA<br>TTTGGGTGAACCTTAACCTATGGCAAAAGTTAAAAATTGGTAGAACGAAGCCAAACCCCTGCAGAGGC<br>TGAAGGGTTTTCCCTCCTTCCCCTTAGTAGAGAGACAAGCTAATGAAGTGGACTGGTGGGATATGGTGT<br>GCAATGTTAAAAAATTGATTAATGAGAAGAAAGAGGATGGTAAAGTGTTTTGGCAGAATCTTGCTGGCT<br>ACAAGAGACAGGAAGCTTTACTGCCTTATTTATCTTCTGAGAAGAAAAAGGTAAAAATTTG<br>CTAGATATCAATTCGGAGACCTACTTCTGCATTTAGAAAAAAAACATGGCGAAGATTGGGGTAAAGTTT<br>ATGATGAAGCCTGGGAAAGAATTGATAAGAAGGTAGAAGGTCTCTCCAAACATATTAAATTAGAGGAA<br>GAACGTAGGTCCGAAGACGCTCAATCAAAGGCAGCATTAACTGATTGGTTGAGAGCAAAAGCCTCTTTC<br>GTTATTGAAGGATTAAAAGAAGCCGACAAAGATGAATTTTGTAGATGTGAGTTAAAGTTGCAAAAGTGG<br>TATGGAGACCTCCGTGGTAAACCTTTTGCTATTGAGGCTGAAAATTCTATACTCGATATCTCTGGATTTTC<br>AAAACAATATAACTGCGCATTTATATGGCAGAAAGATGGTGTTAAAAAGCTAAATCTATACTTAATTAT<br>TACACTGTTATCAATAAAAAATCTGGGGAAATCGTACCAATGAAGTTAATTTCAATTTCGATGATCCTA<br>ATCTTATTATTTTACCTCTTGCTTTCGGCAAAAGGCAAGGTAGGGAGTTTATTTGGAATGATTTATTGTCG<br>CTGGAAACGGGGTCTCTCAAACTCGCAAACGGTAGGGTGATAGAAAAAACATTATACAACAGGAGAAC<br>TCGGCAGGATGAGCCAGCTCTTTTTGTGGCTCTGACATTCGAGAGAAGGGAAGTTTTAGATTCATCTAAC<br>ATCAAACCAATGAATTTAATAGGTATTGACCGGGGTGAAAATATACCTGCAGTTATTGCTTTAACTGATC<br>CTGAGGGATGTCCTCTTAGCAGATTCAAGGACTCGTTGGGTAACCCTACTCACATCTTAAGGATTGGAGA<br>AAGTTACAAGGAGAAACAAAGGACAATACAAGCTGCTAAAGAAGTAGAACAAAGGAGGGCGGGTGGA<br>TATAGTCGGAAATATGCCAGCAAGGCCAAGAATTTAGCTGACGACATGGTTAGGAATACAGCTAGAGAC<br>CTTTTATACTATGCCGTCACCCAGGATGCCATGTTGATATTTGAAAATTTAAGTAGAGGCTTCGGTAGAC<br>AAGGTAAGCGCACCTTCATGGCAGAGAGACAATATACTAGAATGGAAGATTGGTTGACTGCCAAATTGG<br>CATACGAAGGTCTACCTAGTAAGACGTACTTATCTAAAACACTAGCGCAGTATACTTCCAAGACATGCA<br>GTAATTGTGGTTTCACAATCACTTCTGCCGATTACGATCGCGTCTTGGAAAAACTAAAAAAAACAGCGA<br>CAGGTTGGATGACTACTATTAATGGGAAAGAATTGAAGGTCGAAGGACAAATAACTTACTATAATAGAT<br>ATAAACGGCAAAACGTTGAAAAGACCTGTCAGTCGAACTCGATCGACTTAGTGAAGAATCTGTTAATA<br>ATGATATTAGTTCGTGGACAAAAGGTAGATCCGGTGAAGCTTTGAGCCTCCTGAAAAAACGTTTTAGCC<br>ATAGGCCTGTCCAAGAAAGTTTGTATGTTTAAACTGTGGTTTTGAGACCCATGCAGACGAGCAGGCCG<br>CTCTTAATATTGCTAGATCATGGTTATTTTTAAGATCTCAGGAATACAAGAAGTACCAGACTAACAAGAC<br>AACAGGCAACACAGATAAGCGAGCATTCGTTGAGACTTGGCAATCTTTTATAGAAAGAAATTGAAGGA<br>AGTCTGGAAACCA |
| 147 | ATGGGAAAAATGTATTATCTAGGCCTGGACATAGGGACCAATTCAGTAGGCTACGCTGTCACTGACCCC<br>TCCTACCATTTGCTGAAGTTCAAGGGGAACCCATGTGGGGAGCACGTGTTTGCGGCCGGCAAGTAA<br>AGCGCAGAGCGGAGAAGCTTCCGCACCTCCAGGAGAAGGCTGGATCGCAGGCAGCAGCGTGTGAAGCT<br>GGTCCAAGAGATATTTGCCCCAGTGATTTCCCCATCGATCCGCGCTTCTTTATTAGGCTCCACGAGTCC<br>GCTCTCTGGCGCGACGACGTGGCCGAAACTGATAAACATATTTTCTTTAATGACCCAACATACACTGACA<br>AGGAGTACTATTCAGATTACCCAACAATTCACCATTTGATCGTGGACCTTATGGAAAGTTCGGAGAAGC<br>ATGATCCTCGACTTGTCTATTTGGCCGTGGCGTGGCTCGTGGCACATAGGGGCCACTTCTTGAACGAGGT |

TABLE 5-continued

| SEQ ID NO | Sequence |
|---|---|
| | GGACAAGGATAACATCGGGGATGTGTTATCTTTCGACGCTTTCTATCCTGAATTCCTTGCTTTTCTGTCTG<br>ACAATGGCGTCAGCCCGTGGGTCTGCGAATCCAAGGCCCTCCAGGCTACGCTATTGTCAAGAAATAGCG<br>TGAACGACAAGTACAAGGCTCTTAAGTCTTTGATTTTTGGAAGCCAGAAGCCCGAGGACAACTTTGATG<br>CAAATATCTCGGAGGACGGGCTGATTCAGCTCCTCGCTGGGAAAAAGGTCAAGGTCAATAAGCTGTTTC<br>CACAGGAGTCAAATGACGCGAGCTTCACCCTTAACGACAAAGAGGATGCCATTGAAGAGATCCTGGGG<br>ACACTCACCCCAGACGAGTGCGAGTGGATAGCCCATATTAGGCGCCTCTTTGATTGGGCCATAATGAAA<br>CATGCGCTTAAGGACGGGCGCACGATATCCGAAAGCAAGGTCAAATTGTACGAGCAGCACCACCATGAT<br>CTGACCCAGCTAAAATATTTTGTAAAAACATATCTGGCCAAGGAGTACGATGATATCTTCCGCAACGTG<br>GATAGTGAGACCACCAAAAACTACGTCGCGTACTCATACCACGTGAAAGAAGTTAAGGGCACGCTGCCT<br>AAGAACAAGGCAACACAAGAGGAGTTCTGCAAGTACGTTCTCGGGAAAGTTAAAAATATAGAGTGCAG<br>CGAGGCCGACAAAGTGGATTTTGACGAGATGATTCAACGCCTGACCGACAATTCGTTTATGCCTAAACA<br>GGTGAGTGGAGAGAATCGCGTGATTCCATATCAGCTCTATTACTATGAACTCAAGACTATTCTGAATAA<br>GGCCGCTAGCTATTTACCCTTCCTTACGCAGTGCGGGAAGGATGCCATTTCTAACCAGGATAAACTCTTG<br>AGTATAATGACATTTCGAATTCCCTATTTCGTGGGTCCGCTTCGTAAGGATAACAGTGAGCACGCTTGGC<br>TGGAGCGGAAGGCTGGCAAAATTTATCCATGGAATTTCAACGACAAGGTGGATCTGGACAAATCCGAAG<br>AAGCCTTTATCCGCAGGATGACCAATACTTGCACATACTATCCTGGGGAGGATGTCCTTCCACTGGACTC<br>TCTGATCTACGAAAAGTTCATGATTTTGAATGAAATTAACAACATAAGGATCGATGGGTATCCTATTTCC<br>GTCGACGTGAAGCAGCAGGTGTTCGGGCTCTTTGAGAAGAAGCGACGGGTGACCGTGAAGGATATTCAG<br>AATCTTCTCTTATCGCTGGGAGCCCTGGATAAACACGGAAAACTGACCGGGATAGATACTACGATTCAT<br>TCTAATTACAACACGTATCACCATTTTAAGTCACTGATGGAGAGGGGCGTCCTAACAAGAGATGACGTG<br>GAGAGAATAGTGGAACGAATGACATATTCTGATGACACCAAGAGATGCGGCTTTGGCTGAATAACAA<br>CTACGGCACTCTGACGGCGGATGATGTAAAGCATATTTCCCGACTCCGTAAGCATGACTTCGGGCGGCT<br>GTCTAAGATGTTTCTAACAGGCCTCAAGGGTGTGCATAAGGAAACTGGGGAGCGCGCTAGCATCCTGGA<br>TTTTATGTGGAACACCAATGATAACCTGATGCAGCTCCTGTCAGAATGCTACACATTTTCGGACGAAATC<br>ACCAAGCTGCAGGAGGCTTACTATGCCAAGGCCCAACTAAGCTTGAATGATTTCCTGGATTCTATGTACA<br>TCAGCAACGCCGTAAAACGACCAATTTATAGGACACTGGCAGTGGTTAACGACATTAGGAAAGCATGCG<br>GAACAGCTCCCAAGCGAATCTTTATCGAGATGGCCCGCGACGGCGAGAGTAAGAAGAAAAGGTCAGTG<br>ACTAGGCGGGAGCAGATCAAGAACCTTTACCGCTCTATCCGAAAAGACTTCCAGCAAGAGGTTGATTTC<br>CTTGAGAAGATCTTAGAGAACAAGTCAGATGGACAGCTCCAATCCGATGCTCTGTATCTGTACTTCGCTC<br>AGCTGGGACGAGATATGTACACTGGCGACCCCATTAAACATAGAACATATCAAGGACCAATCGTTTTATA<br>ATATCGACCACATCTACCCTCAGTCCATGGTGAAAGACGATAGTCTGGACAATAAGGTGCTCGTCCAAA<br>GTGAGATTAACGGAGAAAGTCGAGCAGATATCCTTTGGACGCTGCGATCCGCAACAAGATGAAGCCCC<br>TGTGGGATGCTTACTACAATCATGGCTGATCAGCCTGAAGAAGTATCAGAGACTGACCCGGAGTACCC<br>CTTTCACAGACGATGAGAAGTGGGATTTTATCAATAGACAACTGGTGGAAGACCAGGCAGTCCACGAAAG<br>CTCTGGCCATTCTTCTGAAGAGAAAGTTTCCAGACACAGAGATCGTCTATTCAAAGGCCGGCCTCAGTTC<br>CGACTTTAGACATGAGTTCGGACTCGTTAAATCACGAAATATAAACGATCTCCACCATGCAAAGGACGC<br>ATTCCTCGCGATTGTGACTGGAAATGTCTATCACGAAAGATTTAATAGGCGGTGGTTCATGGTTAACCAG<br>CCATACTCAGTGAAGACCAAGACCCTTTTCACTCACTCTATTAAAAATGGCAACTTCGTGAGCTTGGAATG<br>GTGAGGAGGATCTTGGAAGAATTGTGAAGATGTTAAAACAGAATAAGAATACCATCCACTTTACTAGAT<br>TCAGCTTTGACCGAAAAGAGGGGCTATTCGATATTCAACCGTTAAAGGCTTCAACAGGTCTCGTTCCACG<br>AAAGGCCGGACTGGACGTAGTGAAATACGGCGGCTATGATAAGAGCACCGCAGCTTACTACCTCCTTGT<br>GCGATTTACGCTCGAGGATAAGAAGACCCAACACAAGCTGATGCATTCCCGTGGAGGGACTGTACAA<br>AGCTCGAATTGACCATGATAAAGAGTTTCTCACAGATTACGCACAAACCACCATCTCTGAGATTCTCCAG<br>AAAGACAAACAAAAAGTTATAAACATAATGTTTCCAATGGGTACAAGGCATATTAAACTGAACAGCATG<br>ATCTCCATTGATGGCTTTTATTTGTCCATTGGAGGAAAGTCTAGTAAAGGCAAGTCTGTCCTCTGCCATG<br>CCATGGTACCCCTAATCGTCCCACACAAGATTGAATGCTACATCAAGGCTATGGAGAGTTTTGCTCGGA<br>AATTTAAAGAGAATAATAAGCTGCGTATTGTGGAAAAATTCGACAAGATAACCGTTGAAGACAATCTGA<br>ATCTGTACGAGCTCTTTCTGCAGAAGCTGCAGCATAACCCCTATAATAAGTTCTTCTCCACACAGTTCGA<br>TGTACTGACCAACGGGCGATCAACTTTCACAAAGCTAAGTCCTGAGGAACAGGTGCAAACACTCCTAAA<br>CATTCTTTCCATTTTTAAGACCTGCAGATCTTCAGGATGCGACTTGAAGACGTCAACGGGAGCGCACAG<br>GCAGCTAGGATCATGATCTCAGCTGACCTGACAGGGCTGAGTAAAAAATACTCCGACATTCGGCTTGTA<br>GAGCAAAGCGCCAGTGGGTTGTTCGTTAGTAAGTCGCAGAACCTGCTGGAATACCTGTAA |
| SEQ ID NO: 148 | ATGTCTTCTTTGACGAAGTTTACAAACAAATACTCTAAGCAGCTTACAATTAAGAACGAACTGATTCCCG<br>TAGGAAAGACTCTGGAAAACATCAAAGAGAATGGGCTGATAGACGGCGACGAACAACTGAATGAGAAC<br>TATCAGAAGGCCAAAATTATCGTGGATGACTTCCTGAGGGATTTTATTAACAAGGCCCTGAATAATACC<br>CAGATCGGCAATTGGCGGGAACTGGCCGACGCTCTGAACAAAGAAGATGAGGACAATATCGAAAAATT<br>ACAAGACAAATCAGGGGCATTATTGTCAGTAAGTTCGAGACATTCGATCTGTTCTCTTCGTACTCCATT<br>AAGAAGGACGAGAAAATCATCGATGATGACAATGACGTTGAGGAAGAAGACATGGACTTGGGTAAAAA<br>GACCTCATCCTTCAAGTATATTTTAAAAAAAATCTGTTTAAATTAGTGCTCCCCAGTTATTTAAAGACA<br>ACTAACCAGGACAAGCTTAAGGATTATCTCCTCTTTTGACAACTTTAGCACCTATTTTAGAGGCTTCTTGA<br>AAATCGCAAGAATATTTTCACTAAGAAGCCCATAAGCACCTCTATTGCCTACAGAATCGTACATGATAA<br>CTTCCCAAAATTTTGGATAACATTAGATGTTTAATGTATGGCAGACCGAATGCCTCAGTTAATTGTG<br>AAGGCGGATAACTACCTCAAATCCAAGAATGTGATCGCCAAAGATAAGTCTCTTGCTAACTACTTTACG<br>GTCGGAGCCTACGATTACTTCTTATCTCAAAACGGTATTGACTTTTACAATAACATTATCGGGGATTGC<br>CTGCCTTCGCCGGCCATGAGAAAATTCAGGGCTTAAACGAGTTCATAAATCAGGAATGTCAAAAGGACT<br>CAGAGCTGAAATCAAAGCTTAAGAATCGCACACGCATTTAAAATGGCGGTCTTGTTCAAACAGATCCTCA<br>GCGATAGAGAAAAGCTTCGTTATTGATGAATTCGAGAGCGACGCACAGGTGATTGATGCCGTGAAGA<br>ACTTCTATGCGGAACAGTGTAAAGACAATAATGTTATTTTCAACCTATTAAACTTGATTAAGAATATCGC<br>GTTTTTAAGTGACGATGAACTCGACGGTATCTTTATAGAAGGCAAGTACCTGTCCTCTGTCAGCCAAAAA<br>CTCTACTCAGATTGGTCCAAGCTAAGAAATGACATCGAGGACAGTCGTAACAGCAAACAGGGCAATAA<br>AGAGCTGGCAAAGAAAATCAAGACTAATAAAGGGGATGTGGAGAAGGCGATATCTAAATATGAGTTCT<br>CCCTCTCCGAACTGAACTCCATCGTCCACGATAATACCAAGTTTAGTGATCTGTTGTCGTGTACACTGCA<br>CAAAGTGGCCAGTGAAAAACTCGTCAAGGTAACGAAGGCGATTGGCCCAAACACCTGAAAAATAATG<br>AGGAGAAACAGAAGATCAAAGAACCTTTGGATGCGTTGCTGAAATATATAACACACTGTTGATCTTCA<br>ACTGTAAAAGCTTCAACAAGAACGGGAACTTTTATGTAGACTACGATCGATGTATAAATGAACTGAGCA |

TABLE 5-continued

| SEQ ID NO | Sequence |
|---|---|
| | GCGTCGTTTACCTGTACAACAAGACTCGCAATTATTGTACGAAAAAACCATATAACACCGATAAGTTCA<br>AGCTTAATTTCAACAGTCCCCAGCTGGGAGAAGGGTTCAGCAAATCAAAAGAAAACGATTGCCTGACAT<br>TACTCTTTAAAAAGGATGATAATTATTATGTTGGGATTATTAGGAAAGGCGCTAAGATCAACTTTGACGA<br>CACACAGGCCATAGCTGACAACACTGATAACTGCATCTTTAAAATGAATTACTTTCTGTTGAAGGACGCC<br>AAAAAATTCATTCCAAATGCTCTATTCAGCTCAAGGAGGTTAAGGCCCATTTCAAGAAGTCTGAAGAT<br>GACTACATCCTCTCTGACAAGGAAAAATTCGCTAGTCCTCTGGTTATCAAAAAAGTACCTTCTTGCTGG<br>CTACAGCTCACGTGAAAGGCAAGAAAGGGAACATTAAGAAGTTCCAAAAGGAATACAGCAAAGAGAAT<br>CCAACCGAGTACAGAAATTCTCTGAACGAATGGATCGCATTCTGTAAAGAATTTCTAAAGACGTACAAG<br>GCCGCTACCATTTTCGATATTACCACCTTGAAAAAAGCCGAGGAGTACGCCGACATCGTCGAATTCTATA<br>AGACGTGGATAACCTGTGTTACAAATTGGAATTCTGCCCAATTAAGACCTCTTTCATTGAAAACCTCAT<br>CGACAATGGGGACCTCTACTTATTTAGAATTAACAATAAGGATTTTTCTTCGAAATCTACCGGAACTAAA<br>AATCTGCACACACTGTATCTGCAAGCAATCTTCGATGAACGTAATCTCAACAACCCTACAATAATGCTGA<br>ACGGCGGTGCTGAACTGTTCTACCGTAAAGAGAGTATTGAACAGAAGAATCTGATCACACACAAAGCG<br>GGCAGTATTCTCGTCAATAAGGTGTGCAAAGACGGGACCAGCCTGGACGATAAGATCAGGAATGAAAT<br>ATATCAGTATGAGAACAAGTTTATCGACACCTTGTCGGATGAGGCAAAGAAGGTGCTACCTAACGTTAT<br>CAAGAAGGAAGCTACCCATGACATAACCAAGGATAAGCGGTTCACTTCTGACAAGTTCTTCTTCCACTG<br>TCCTCTGACCATTAACTACAAGGAAGGAGACACTAAACAATTCAATAATGAAGTACTTAGCTTTTTGCG<br>GGGTAATCCCGATATTAACATAATTGGTATCGACCGGGAGAACGGAACCTGATATACGTGACAGTAAT<br>TAATCAGAAAGGAGAAATCCTGGATTCCGTATCCTTCAATACCGTGACTAATAAATCTAGTAAAATCGA<br>GCAGACGGTCGACTACGAGGAAAAGTTAGCAGTCAGAGAGAAGGAGAGAATCGAGGCCAAACGTTCCT<br>GGGATAGTATCAGCAAGATTCTACTCTGAAAGAAGGATATCTGTCCGCTATCGTCCATGAGATCTGTTT<br>GTTGATGATCAAGCACAATGCTATAGTGGTTCTGGAGAACCTGAACGCAGGCTTCAAGCGAATTAGAGG<br>GGGCCTGTCGGAAAAAGCGTTTACCAGAAGTTTGAAAAGATGCTAATCAATAAGTTAAATTACTTTGT<br>AAGTAAAAAAGAAAGCGATTGGAATAAGCCATCAGGACTTTTAAACGGGCTGCAACTGAGCGACCAGT<br>TTGAGTCATTCGAAAAACTGGGTATTCAGAGTGGTTTCATATTCTACGTACCTGCCGCTTACACTTCAAA<br>GATCGATCCTACAACTGGTTTTGCGAATGTCCTGAATCTGTCTAAGGTGAGGAATGTGGACGCAATCAA<br>GTCTTTCTTCAGCAACTTCAACGAGATATCTTACAGCAAGAAAGAGGCTCTGTTTAAATTCAGTTTTGAT<br>CTGGATAGCCTGAGCAAGAAAGGATTCTCTTCTTTCGTAAAGTTTTCTAAGTCCAAATGGAACGTCTACA<br>CGTTCGGAGAGAGAATCATTAAACCAAAGAACAAGCAGGGGTATCGGAAGTGTATAAAGGATCAATCTG<br>ACTTTCGAAATGAAGAAACTATTGAATGAGTACAAAGTCTCATTCGATTTGGAGAACAATCTGATCCCC<br>AATCTGACCAGCGCTAACCTCAAAGACACATTCTGGAAGGAGCTGTTTTTTCATCTTTAAGACCACCCTGC<br>AGCTACGGAATAGTGTCACAAATGGGAAAGAGGATGTACTGATCTCACCTGTGAAAAACGCCAAGGGG<br>GAGTTCTTTGTGTCCGGCACCCATAACAAAACCCTGCCTCAGGACTGTGACGCGAACGGGGCCTACCAC<br>ATCGCGCTAAAGGGGTTAATGATTCTCGAACGTAATAATCTGGTGCCGAAGAAAAAGACACAAAGAA<br>AATTATGGCCATCAGCAACGTTGACTGGTTTGAGTACGTGCAGAAGCGTCGAGGAGTTTTGTAA |
| SEQ ID NO: 149 | ATGAACAACTATGACGAGTTCACTAAACTTTACCCCATTCAGAAAACCATCAGATTTGAACTGAAGCCT<br>CAGGGTCGTACCATGGAACACTTGGAAACTTTCAACTTTTTCGAGGAGGACAGGGATAGAGCTGAGAAA<br>TACAAGATCTTGAAAGAGGCCATCGACGAGTATCACAAAAAATTCATCGATGAGCATCTCACCAACATG<br>TCGCTGGATTGGAACAGTCTCAAGCAGATTTCCGAGAAGTACTATAAATCTCGGGAGGAGAAAGATAAA<br>AAGGTGTTTTTGAGCGAGCAAAAGCGAATGCGACAGGAGATAGTCTCTGAATTTAAGAAAGATGATCGG<br>TTTAAAGACCTATTTTCCAAAAAGCTTTTTTCAGAGCTGCTAGATAGAGAGATCTATAAAAAAGCAAT<br>CACCAAGAAATTGATGCCCTGAAATCATTCGACAAATTCAGTGGGTATTTCATAGGACTGCATGAGAAC<br>CGGAAGAATATGTATAGTGATGGAGACGAGATCACAGCCATAAGCAATCGAATCGTTAACGAGAATTTC<br>CCGAAGTTCCTGGATAACCTGCAGAAGTATCAAGAGGCTAGGAAAAAGTACCCTGAGTGGATCATCAAG<br>GCTGAATCAGCTCTGGTGGCTCACAATATCAAGATGGATGAAGTCTTTAGTCTTGAGTACTTTAATAAAG<br>TCCTTAACCAGGAGGGCATCCAGCGCTATAACCTGGCTCTCGGTGGCTACGTCACAAAAAGCGGAGAAA<br>AGATGATGGGTCTCAACGATGCACTGAATTTGGCTCATCAGTCGGAGAAGTCATCTAAGGGACGCATAC<br>ACATGACACCACTGTTTAAACAAATCCTGAGCGAAAAGGAATCATTTTCCTACATTCCCGACGTATTCAC<br>CGAGGACTCACAACTGCTGCCTAGTATAGGGGGGTTTTCTGCTCAGATAGAGAACGACAAAGATGCAA<br>CATTTTTTGACAGAGCCTTGGAGTTGATTTCATCTTACGCCGAGTACGATACGGAGCATTTATATTCGC<br>CAGGCGGATATCAACAGGGTTTCCAATGTGATCTTTGGCGAGTGGGAACGCTGGGCGGGCTGATGCGG<br>GAATACAAAGCCGACTCGATCAATGACATCAACCTGGAGAGAACATGCAAGAAGGTCGATAAATGGTT<br>GGATAGCAAAGAGTTCGCCCTGAGTGACGTCTTGGAAGCTATCAAAAGACCGGAAATAATGACGCGTT<br>CAACGAGTATATCTCTAAAATGAGGACCGCGAGAGAAAAAATTGATGCAGCAAGGCAAGGAGATGAAGT<br>TTATATCTGAGAAGATCTCAGGCGATGAAGAGTCCATCCATATTATTAAAACTCTTCTGGACTCAGTGCA<br>GCAATTCCTGCACTTTTTTAACCTCTTCAAGGCCAGGCAGGATATACCGTTAGACGGGGCTTTTTATGCC<br>GAGTTTGATGAAGTTCATTCGAAACTTTTTGCTATAGTGCCTCTCTATAATAAAGTTCGCAATTACCTGA<br>CAAAGAATAACTTAAACACAAAGAAAATCAAGCTCAACTTCAAAAACCCAACACTGGCAAACGGATGG<br>GATCAGAACAAGGTATATGATTACGCCTCATTGATTTTCCTCCGGGACGGGAATTACTATCTGGGGATCA<br>TCAACCCTAAGCGCAAAAAGAACATTAAGTTCGAACAGGGATCTGGCAATGGTCCCTTCTATAGGAAAA<br>TGGTATACAAACAGATTCCTGGCCCCAACAAGAATCTCCCACGCGTCTTTCTGACGTCCACTAAGGGAA<br>AGAAGGAGTACAAGCCGTCTAAAGAAATTATCGAGGGCTATGAGGTCGACAAGCATATTAGGGGTGAC<br>AAGTTTGACCTAGACTTTTGTCATAAGCTTATCGACTTTTTCAAGGAGTCCATAGAGAAGCACAAAGATT<br>GGTCAAAGTTTAATTTCTATTTTTCTCCAACAGAGTCCTACGGGGATATCTCTGAGTTCTATCTGGATGTT<br>GAAAAGCAGGGGTACAGAATGCACTTCGAAAATATCTCAGCAGAAACTATCGATGAGTACGTAGAGAA<br>AGGAGATCTGTTTCTTTTCCAAATCTACAATAAGGATTTTGTGAAGGCCGCACTGGGAGAAGGACAT<br>GCACACTATTTACTGGAACGCTGCATTTTCCCCTGAAAATCTGCAGGACGTAGTAGTGAAATTAAATGGT<br>GAGGCAGAACTGTTTTACCGCGATAAATCAGACATCAAGGAAATAGTGCACCGGGAAGGCGAGATTCTT<br>GTTAACCGAACATATAATGGCAGGACACCTGTCCCTGATAAAATTCATAAGAAACTGACCGATTACCAC<br>AACGGTCGAACCAAGGATCTGGGCGAGGCCAAGGAATACCTTGATAAGGTGAGGTACTTCAAAGCCCA<br>TTATGACATCACCAAGGACCGAAGATACCTTAACGACAAAATCTACTTCCATGTCCCACTCACCTTGAAC<br>TTCAAAGCTAACGGTAAGAAGAACCTCAATAAAATGGTGATTGAAAATTTCTGTCCGATGAGAAGGCC<br>CATATCATCGGCATTGATCGCGGCGAGAGAAATCTCCTTTACTATTCTATCATTGATCGGTCGGGAAAGA<br>TTATCGACCAACAATCACTGAATGTCATCGACGGATTCGACTATAGAGAGAAGCTGAACCAACGGGAAA<br>TCGAGATGAAGGACGCGCGCCAGTCCTGGAACGCTATCGGCAAAATTAAAGATTTGAAAGAAGGTTACC |

TABLE 5-continued

| SEQ ID NO | Sequence |
|---|---|
| | TCTCCAAAGCAGTGCACGAAATTACCAAAATGGCAATCCAGTACAATGCTATTGTGGTAATGGAGGAGT<br>TAAATTACGGATTTAAGCGCGGGAGGTTCAAGGTTGAAAAGCAAATTTACCAAAAATTTGAGAACATGT<br>TGATTGATAAGATGAACTACCTGGTGTTCAAGGACGCACCTGACGAGTCGCCAGGCGGCGTGTTAAATG<br>CATATCAGCTGACAAATCCACTGGAGAGCTTTGCCAAGCTAGGAAAGCAGACTGGCATTCTCTTTTACGT<br>CCCTGCAGCGTATACATCCAAAATTGACCCCACCCACTGGCTTCGTCAATCTGTTTAACACCTCCTCCAAA<br>ACCAACGCACAAGAACGGAAAGAATTTTTGCAAAAGTTTGAGTCCATTAGCTACTCTGCCAAAGACGGC<br>GGGATCTTTGCTTTCGCATTCGACTACAGGAAATTCGGGACGAGTAAGACAGACCACAAGAACGTCTGG<br>ACCGCGTACACTAATGGGGAACGCATGCGCTACATCAAAGAGAAAAAGAGGAATGAACTTTTTGACCCT<br>TCAAAGGAAATCAAGGAAGCTCTCACCTCAAGCGGTATCAAATACGATGGCGGGCAGAATATTTTGCCA<br>GATATCCTCAGATCGAACAATAATGGACTTATCTATACTATGTACTCCTCCTTCATTGCAGCAATTCAAA<br>TGAGAGTGTACGATGGAAAGGAGGATTACATTATATCGCCAATTAAGAACTCCAAAGGCGAATTCTTCC<br>GCACGGATCCTAAGCGAAGAGAACTCCCAATCGACGCTGATGCGAACGGCGCCTATAATATAGCCCTGC<br>GGGGTGAATTAACAATGCGCGCTATTGCCGAGAAGTTCGACCCCGATTCAGAAAAAATGGCTAAGCTTG<br>AGCTGAAACACAAAGATTGGTTCGAATTCATGCAGACAAGAGGCGACTAA |
| SEQ ID NO: 150 | ATGACTAAGACCTTCGATTCCGAGTTCTTCAACCTTTATTCCCTGCAGAAAACTGTAAGGTTTGAGCTGA<br>AGCCGGTGGGCGAGACAGCCAGCTTCGTAGAGGATTTCAAGAATGAGGGTCTCAAACGGGTAGTTAGTG<br>AGGATGAGAGGAGAGCAGTGGACTATCAGAAGGTGAAAGAGATCATCGATGACTATCACCGGGATTTC<br>ATAGAGGAGTCGTTGAATTACTTCCCTGAGCAAGTATCCAAAGACGCGCTGGAACAGGCCTTTCATCTTT<br>ACCAGAAACTGAAGGCAGCGAAGGTTGAGGAGCGGGAAAAGGCCTTGAAAGAGTGGGAAGCCCTGCA<br>GAAAAAGCTCAGAGAAAAGGTTGTCAAATGCTTCAGCGACAGCAACAAAGCCAGGTTCAGTAGGATCG<br>ATAAGAAAGAACTGATCAAAGAAGACTTGATCAATTGGCTGGTTGCACAGAACCGGGAAGATGATATTC<br>CCACCGTAGAGACCTTCAACAACTTCACAACTTACTTCACCGGCTTCCATGAGAATCGTAAAAACATCTA<br>CAGTAAAGATGATCATGCAACCGCCATCTCCTTCCGGTTGATCCACGAGAATCTCCCCAAGTTCTTTGAC<br>AACGTGATAAGTTTTCAATAAGTTGAAAGAGGGATTTCCCGAACTCAAGTTCGATAAAGTGAAGGAGGAT<br>CTGGAAGTGGATTATGACCTTAAGCACGCTTTCGAGATAGAGTACTTCGTGAACTTTGTGACTCAGGCCG<br>GCATCGATCAGTATAACTACCTCCTCGGGGGTAAGACGCTCGAGGACGGTACTAAGAAGCAAGGAATG<br>AATGAGCAAATTAATCTATTTAAACAGCAGCAGACCAGGGATAAGGCTAGACAGATCCCCAAGCTTATT<br>CCTCTTTTTAAACAGATCCTAAGTGAAAGGACAGAAATTCAAAGCTTCATCCTAAGCAATTTGAAAGT<br>GATCAGGAGCTGTTTGACTCCCTGCAAAAGCTGCACAACAATTGCCAGGACAAGTTTACCGTGCTGCAG<br>CAGGCTATCCTCGGACTGGCTGAGGCGGATCTTAAGAAGGTATTCATTAAGACTAGCGACCTCAATGCC<br>CTTAGTAACACCATCTTTGGAAATTACTCCGTTTTCAGCGATGCCCTCAATCTATACAAAGAGAGCTTGA<br>AGACTAAAAAAGCTCAGGAAGCTTTTGAAAAATTACCGGCACATTCTATACACGACCTTATACAATACT<br>TAGAGCAGTTCAACAGCAGCCTCGACGCTGAGAAACAGCAATCCACAGACCGTCCTGAATTACTTCA<br>TCAAAACCGATGAACTGTACTCCCGATTTATCAAGAGCACTTCAGAAGCCTTCACGCAAGTTCAGCCTCT<br>GTTCGAGCTGGAGGCACTGTCCAGCAAGAGACGACCGCCAGAGTCTGAAGACGAGGGAGCCAAGGGTC<br>AAGAGGGGTTTGAACAGATAAAGCGAATTAAGGCTTACTTGGATACTCTCATGGAGGCGGTGCATTTCG<br>CTAAGCTTTTGTACCTGGTTAAAGGCCGAAAAATGATTGAGGGGCTAGATAAGGATCAGTCTTTTTACG<br>AGGCTTTTGAAATGGCCTACCAGGAATTGGAATCCTTGATCATTCCAATCTATAATAAAGCCCGGAGTTA<br>TCTGAGCAGGAAGCCCTTCAAAGCCGACAAGTTCAAAATAAATTTTGACAATAATACGCTACTGTCTGG<br>TTGGGACGCTAACAAGGAAACAGCCAATGCTTCCATCCTGTTTAAGAAAGACGGCCTGTACTACCTGGG<br>AATTATGCCAAAAGGCAAACTTTTTTGTTCGATTACTTTGTCAACAATCAGAGGATAGCGAGAAGTTAAG<br>CAAAGACGGCAGAAGACCGCCGAAGAAGCCCTCGCACAAGACGGAGAATCATATTTCGAGAAAATTCG<br>ATATAGCTCCTGCCTGGCGCATCAAAGATGTTGCCAAAAGTCTTCTTTTCCAACAAAAACATCGGCTTT<br>TATAACCCCAGCGATGATATCCTTCGCATCCGGAACACCGCCTCACATACCAAAAATGGAACTCCACAG<br>AAGGGCCACTCGAAGGTTGAATTCAACCTTAACGATTGTCACAAAATGATTGATTTTTTAAGAGCTCCA<br>TTCAGAAACACCCCGAATGGGGGTCCTTTGGCTTCACCTTTTCTGATACTTCAGACTTCGAGGACATGTC<br>CGCCTTCTACAGGGAGGTGGAGAACCAGGGCTATGTCATCTCCTTCGACAAAATAAAGAGACATACAT<br>TCAGAGCCAGGTCGAGCAGGGAAATCTGTACCTGTTTCAGATCTATAACAAGGATTTCAGTCCCTATAG<br>CAAGGGCAAGCCCAATTTACATACCCTGTACTGGAAGGCCCTGTTCGAAGAGGCAAACCTTAACAATGT<br>AGTTGCTAAGCTGAATGGGGAAGCAGAGATCTTCTTCCGAAGGCACAGCATCAAGGCAAGCGACAAAG<br>TTGTACATCCTGCTAACCAGGCCATCGATAACAAGAACCCGCATACAGAAAAGACACAGTCAACCTTTG<br>AATACGACCTCGTGAAGGACAAGAGGTACACACAAGATAAATTCTTCTTCCACGTGCCCATCAGCTTGA<br>ATTTTAAAGCGCAGGGAGTGAGCAAATTTAAAGACAAGGTCAACGGCTTCCTGAAGGGAAACCCCGAC<br>GTGAATATCATCGGAATTGATCGCGGTGAAAGACATCCTCTACTTTACTGTGGTGAACCAGAAGGGT<br>GAGATCCTAGTACAGGAGAGCCTGAACACCCTTATGAGTGATAAGGGCCATGTGAATGATTACCAGCAG<br>AAGCTGGACAAGAAGGAACAGGAAAGGGACGCAGCGCGGAAGTCCTGGACCACTGTTGAGAATATCAA<br>AGAACTGAAGGAGGGATATCTTAGCCATGGTACACAAACTTGCACATCTGATTATCAAGTATAATGC<br>CATAGTCTGCCTGGAAGACTTGAACTTCGGTTTCAAGCGAGGAAGGTTTAAAGTGGAGAAGCAGGTGTA<br>CCAGAAGTTTGAGAAAGCCCTTATTGATAAGCTAAACTACCTTGTCTTTAAGGAAAAAGAACTCGGCGA<br>AGTTGGCCACTATTTAACCGCCTACCAACTAACCGCCCCTTCGAGTCTTTTAAGAAACTGGGAAAGCAG<br>AGCGGAATACTCTTCTATGTGCCTGCAGACTACACCTCTAAGATCGACCCCACTACCGGCTTTGTAAACT<br>TTCTAGATCTCCGCTATCAGTCAGTAGAAAAAGCCAAACAGCTCTTGTCAGATTTTAACGCCATCCGATT<br>TAATTCCGTCAAAATTACTTCGAGTTCGAAATCGACTATAAAAAACTTACCCCCAAGAGAAAGGTTGG<br>GACGCAGTCCAAGTGGGTAATCTGCACTTACGGTGACGTGAGATACCAGAACCGCCGAAACCAGAAAG<br>GTCATTGGGAAACCGAGGAAGTGAATGTGACTGAGAAGCTCAAGGCCCTCTTCGCTAGCGACAGTAAAA<br>CAACACAGTTATCGATTACGCCAATGACGATAATCTTATAGACGTGATCTTGGACAACGAACAAAGCCT<br>CTTTTTTTAAGGAATTGTTGTGGTTGCTGAAACTTACAATGACCCTTAGGCACAGCAAGATCAAATCAGA<br>GGATGACTTCATCCTCAGCCCGGTGAAGAATAACAGGGAGAGTTCTACGATTCACGGAAGGCTGGAGA<br>GGTGTGGCCCAAGGATGCCGACGCGAACGGGGCCTACCACATAGCTCTAAAAGGTCTGTGGAACCTGCA<br>ACAAATCAATCAATGGGAGAAAGGTAAGACACTGAACCTGGCCATCAAAAATCAAGATTGGTTCTCATT<br>CATCCAGGAAAAGCCTTATCAAGAGTGA |
| SEQ ID NO: | ATGCATACGGGAGGCCTTTTATCAATGGACGCAAAAGAGTTCACCGGGCAGTATCCATTATCTAAGACA<br>CTCCGCTTCGAGCTGAGGCCCATTGGCAGGACCTGGACAACCTGGAGGCGTCGGGCTACCTGGCTGAG<br>GACAGACATCGCGCAGAATGCTATCCGAGAGCTAAGGAGCTTTTGGACGACAATCATCGCGCGTTCCTT |

TABLE 5-continued

| SEQ ID NO | Sequence |
|---|---|
| 151 | AACCGGGTGCTCCCACAGATCGATATGGACTGGCACCCGATCGCTGAGGCTTTTTGCAAGGTCCATAAG<br>AACCCTGGGAACAAAGAGCTCGCCCAGGACTACAACTTGCAGCTGAGCAAGCGACGGAAAGAGATTTC<br>TGCCTACCTTCAAGACGCCGATGGCTACAAAGGGCTCTTCGCAAAGCCCGCATTGGATGAGGCCATGAA<br>AATCGCCAAGGAGAACGGGAATGAAAGTGACATCGAAGTTCTCGAAGCGTTTAACGGATTTAGCGTGTA<br>CTTTACCGGCTATCATGAGTCAAGGGAGAATATTTATAGCGATGAGGACATGGTCTCTGTGGCCTACCG<br>GATTACCGAGGATAATTTCCCGAGGTTTGTTTCAAATGCACTAATATTCGACAAGTTAAATGAGAGCCAC<br>CCAGACATCATCTCGGAGGTCAGCGGCAACCTCGGAGTTGACGATATTGGCAAATACTTCGACGTGAGC<br>AACTATAACAACTTCCTCTCACAGGCTGGCATCGACGACTATAATCATATTATAGGCGGCCACACTACTG<br>AGGATGGTCTCATTCAGGCATTCAATGTAGTCTTGAATCTTAGGCACCAGAAGGACCCTGGGTTTGAAA<br>AGATACAGTTCAAGCAGCTGTATAAGCAGATATTATCCGTGCGAACATCTAAAAGTTACATCCCCAAAC<br>AGTTTGATAACTCAAAGGAGATGGTGGATTGCATATGCGATTATGTGTCAAAAATTGAAAAGAGCGAGA<br>CTGTGGAGCGGGCTCTGAAGCTCGTCAGGAACATTAGCTCCTTTGACCTTAGAGGAATTTTCGTCAATAA<br>AAAGAATCTGAGGATCCTGAGCAATAAGCTAATAGGAGATTGGGACCTCATAGAGACAGCATTGATGC<br>ATTCCAGCTCAAGCGAGAATGATAAGAAGTCTGTCTACGATAGCGCTGAAGCCTTCACGCTGGACGATA<br>TCTTCTCTTCCGTGAAAAAATTTAGTGATGCGTCCGCAGAGATATCGGGAATCGAGCCGAAGATATCT<br>GCAGGGTAAATTTCAGAGACCGCCCCTTTCATCAATGACCTGCGCGCCGTGGACCTGGATAGCCTGAATG<br>ACGATGGTTACGAAGCTGCAGTTTCTAAGATCAGGGAGTCTCTGGAGCCATATATGGACTTTGTTTCACGA<br>ACTTGAGATCTTTAGCGTGGGCGACGAGTTCCCGAAATGCGCAGCTTTCTATAGCGAGTTAGAGGAGGT<br>CAGCGAGCAATTAATCGAGATCATACCCCTGTTTAATAAGGCACGGAGCTTTTGTACTCGCAAGCGCTA<br>CAGCACCGACAAGATTAAAGTTAATCTGAAATTTCCAACTCTCGCAGAGGGTGGGACCTAAACAAGGA<br>ACGCGATAATAAAGCCGCATCCTTAGAAAGGACGGAAAGTACTATCTTGCCATCCTAGATATGAAAAA<br>AGATCTGAGTTCCATTCGTACTAGCGATGAAGACGAATCTTCTTTCGAAAAAATGGAGTATAAGCTGCTC<br>CCCTCGCCAGTCAAGATGCTACCCAAGATCTTTGTGAAGAGCAAAGCAGCCAAGGAAAAGTACGGGCTG<br>ACGGACAGGATGCTGGAGTGCTACGATAAGGGAATGCATAAATCAGGGTCAGCTTTTGACTTGGGCTTT<br>TGCCATGAGCTAATCGATTACTACGAGCGCTGTATCGCCGAGTATCGCAGGATGGGACGTTTTCGACTTTA<br>AATTTCGGGAGACTTCTGATTATGGTTCAATGAAGGAGTTCAACGAAGATGTCGCTGGTGCCGGTTACTA<br>CATGAGCCTTCGCAAGATTCCTTGTTCCGAAGTCTACCGGCTACTGGACGAGAAATCTATATATTTGTTC<br>CAGATATATAACAAGGACTACAGTGAGAATGCACATGGGAATAAGAATATGCATACTATGTATTGGGAA<br>GGTCTCTTTTCACCCCAAAATTTGGAGTCACCCGTGTTCAAACTTAGCGGTGGCGCAGAGCTGTTCTTTA<br>GGAAATCCAGTATACCCAATGACGCCAAGACAGTCCACCCAAAGGGTAGCGTCCTGGTGCCCAGAAAC<br>GATGTGAACGGCAGGAGAATCCCTGACAGCATTTACCGAGAACTTACCAGGTACTTCAACCGCGGCGAC<br>TGTAGAATCTCTGATGAGGCAAAGTCTTATCTGGATAAGGTGAAGACTAAGAAGGCAGATCATGACATT<br>GTGAAAGACCGCGCTTTACTGTCGACAAAATGATGTTTCACGTGCCTATCGCAATGAATTTTAAGGCAA<br>TCTCAAAACCGAATCTGAACAAGAAGGTGATAGATGGCATTATGATGACCAGGACCTCAAGATCATCG<br>GAATCGACAGAGGTGAGCGAAACCTGATATACGTCACAATGGTAGATCGGAAGGGTAATATTCTGTACC<br>AGGATTCACTAAACATCCTCAATGGATATGACTATCGAAAAGCTCTCGATGTCAGGGAATACGACAACA<br>AGGAGGCGCGACGGAATTGGACAAAGGTGGAAGGCATACGGAAGATGAAGGAAGGCTATCTGTCACTA<br>GCTGTCTCCAAATTGGCTGATATGATTATAGAGAACAACGCATTCGTGATGGAAGATCTCAACCAT<br>GGATTCAAGGCAGGAAGAAGTAAAATTGAGAAGCAGGTGTATCAGAAGTTCGAAAGCATGCTTATTAA<br>TAAGTTGGGTTATATGGTCTTAAAGGACAAGTCTATCGATCAGAGCGGCGGCGCACTCATGGGTATCA<br>GCTGGCTAACCATGTCACCACACTAGCATCCGTAGGCAAACAGTGTGGCGTGATTTTCTACATTCCTGCT<br>GCGTTCACTTCTAAGATCGATCCTACCACGGGATTCGCAGACCTGTTCGCATCGAGCAATGTTAAAAACG<br>TGGCCTCCATGAGGGAGTTCTTTAGCAAAATGAAAAGCGTGATTTATGACAAGGCCGAGGGCAAGTTCG<br>CTTTCACATTTGACTACCTGGACTACAATGTGAAATCAGAGTGCGGGAGAACCCTGTGGACCGTATACA<br>CGGTAGGGGAAAGATTCACTTACAGTCGAGTTAATCGGGAGTATGTCCGTAAAGTGCCAACTGACATCA<br>TCTACGATGCCCTTCAGAAGGCTGGCATAAGTGTTGAGGGGGATCTAAGGGACAGGATCGCTGAATCGG<br>ATGGCGATACTCTCAAATCAATCTTCTACGCCTTCAAGTATGCCCTCGACATGAGGGTAGAGAACCGGG<br>AGGAGGACTATATACAGTCTCCCGTGAAGAATGCGTCGGGAGAGTTCTTCTGCTCAAAAAACGCCGGGA<br>AATCTTTGCCGCAGGATTCTGATGCAAATGGGGCTTATAACATTGCTCTCAAAGGCATCCTGCAGCTGCG<br>CATGCTATCTGAACAATATGACCCAAACGCTGAAAGCATTAGATTGCCATTGATCACCAATAAGGCTTG<br>GCTGACTTTCATGCAGAGCGGTATGAAGACATGGAAAAACTAA |
| 152 | ATGGATTCCCTTAAGGACTTCACAAATCTTTACCCCGTGAGTAAAACCCTGAGATTTGAACTCAAGCCCG<br>TGGGAAAGACTCTCGAGAATATCGAGAAGGCCGGGATTTTGAAGGAGCGAGCATCGGGCAGAAGT<br>TACAGACGGGTGAAGAAGATTATAGATACTTATCACAAGGTCTTTATAGACAGCTCTTTAGAGAACATG<br>GCAAAGATGGGCATCGAGAACGAAATCAAGGCCATGCTGCAGTCCTTCTGCGAGCTGTATAAAAAGGAT<br>CATCGGACCGAAGGCGAAGACAAGGCGCTGGATAAGATCAGGGCAGTGCTGCGCGGCCTCATTGTGGG<br>TGCCTTCACTGGGGTGTGCGGGCGGAGAGAACACTGTGCAGAATGAGAAATACGAGAGTTTGTTCAA<br>AGAGAAACTCATCAAGGAAATCCTGCCCGACTTCGTCTTAAGCACAGAAGCCGAATCTCTCCCATTTTCT<br>GTCGAGGAGGCCACGCGTTCCCTTAAAGAGTTCGACAGTTTCACTTCATACTTTGCCGGATTTTATGAAA<br>ACCGTAAAAATATATACTCCACTAAACCACAGTCAACTGCAATAGCTTACAGGTTAATCCACGAAAACC<br>TGCCAAAATTCATCGACAATATACTCGTCTTTCAAAAAATCAAGGAACCAATCGCGAAGGAACTTGAAC<br>ACATCCGGGCTGACTTTAGTGCGGGAGATACATCAAAAAAGACGAGCGCCTGGAGGATATATTTTCAC<br>TAAATTATTATATTCATGTACTGAGCCAGGCTGGCATAGAAAAGTACAACGCTCTAATTGGGAAAATCG<br>TGACAGAAGGTGACGGGAAATGAAAGGGCTAAACGAACATATTAACTTATATAACCAACAGCGGGT<br>CGAGAAGATCGTCTGCCCCTGTTCAGACCTCTGTATAAGCAAATACTCTCCGACAGAGAGCAGCTATCA<br>TATCTGCCCGAGTCCTTTGAGAAAGATGAAGAGCTGCTCCGGGCGCTCAAGGAGTTCTATGATCATATA<br>GCCGAGGACATTTTGGGCAGAACTCAGCAACTCATGACGTCTATTTCTGAATATGATCTGTCTCGTATCT<br>ATGTCAGGAATGATAGCCAGCTGACCGATATATCCAAGAAGATGCTGGGGGACTGGAACGCCATTTATA<br>TGGCGAGGGAGCGAGCATACGATCACGAGCAGGCACCCAAGAGAATCACAGCCAAATATGAGAGAGAC<br>GCATTAAGGCGCTGAAGGGCGAAGAAAGTATCAGTCTGGCCAATCTGAACTCCTGCATAGCTTTCTT<br>GATAACGTGAGGGATTGCAGAGTTGATACTTACCTGAGTACCCCTGGGCCAGAAGGAAGGGCCTCACGGC<br>CTCTCTAATCTAGTGGAGAATGTATTTGCCTCCTACCACGAAGCTGAGCAGCTGCTGTCATTTCCGTACC<br>CAGAGGAAAATAATTTAATACAGGATAAGGCAACGTAGTGCTTATCAAAAATCTACTGGATAACATTT<br>CCGACCTCCAGCGCTTTCTCAAACCACTTTGGGGGATGGGCGACGAGCCTGATAAGGATGAGCGCTTTT<br>ACGGCGAGTACAACTACATCAGGGGCGCCTTGGACCAGGTGATTCCCCTCTATAATAAAGTCAGGAATT |

TABLE 5-continued

| SEQ ID NO | Sequence |
|---|---|
| | ACCTGACCCGAAAGCCATACAGTACAAGAAAGGTGAAATTAAATTTCGGCAATAGTCAGCTGCTGTCTG<br>GTTGGGACCGAAATAAGGAGAAAGACAACAGCTGCGTAATTCTCAGAAAAGGACAGAACTTTTATTTGG<br>CCATCATGAATAACAGACACAAGAGATCTTTCGAGAACAAAGTGCTCCCTGAGTATAAGGAGGGGGAA<br>CCCTACTTCGAGAAGATGGACTATAAATTCCTTCCTGATCCAAATAAAATGCTGCCTAAAGTATTTCTGT<br>CAAAAAAAGGTATAGAAATCTACAAACCTTCACCTAAGCTACTTGAACAGTATGGCCACGGCACCCATA<br>AAAAAGGGGACACGTTCAGCATGGACGACCTACACGAACTGATTGACTTCTTTAAGCACAGCATAGAAG<br>CTCATGAGGACTGGAAACAGTTCGGATTCAAATTCTCAGATACCGCGACCTACGAAAACGTGTCTAGTT<br>TTTACCGGGAAGTCGAGGACCAGGGCTACAAGCTCAGCTTCAGAAAAGTTAGCGAATCTTACGTCTACT<br>CCCTTATAGATCAAGGTAAGCTGTATCTCTTTCAAATCTACAACAAGGACTTTTCCCCATGTAGCAAGGG<br>CACCCCCAATCTGCACACTCTCTACTGGCGGATGCTGTTCGACGAGCGTAACCTGGACAGACGTGATCTAC<br>AAATTAGATGGTAAAGCTGAGATCTTCTTTCGTGAAAAGAGCCTAAAGAACGATCACCCCACTCACCCC<br>GCCGGAAAGCCCATTAAGAAGAAAAGTAGGCAGAAGAAAGGAGAAGAATCGCTATTTGAGTACGACCT<br>CGTCAAGGATCGGCATTATACAATGGATAAGTTCCAGTTCCATGTGCCAATAACTATGAATTTCAAGTGC<br>AGTGCTGGCAGTAAGGTGAATGACATGGTAAACGCTCATATCCGGGAGGCAAAGGACATGCATGTTATT<br>GGAATTGATAGGGGTGAGCGTAATCTCCTCTACATCTGTGTTATTGACTCCCGCGGCACAATCCTCGATC<br>AGATTTCCTTGAATACAATTAATGATATAGACTACCATGACTTGCTTGAGTCTCGCGACAAAGATAGACA<br>GCAGGAGAGAAGAAATTGGCAGACATCGAAGGCATCAAGGAACTCAAGCAAGGCTACCTTTCTCAGG<br>CAGTGCATCGAATAGCCGAGCTGATGGTGGCTTATAAAGCCGTCGTGGCACTAGAAGACCTAAATATGG<br>GATTTAAACGAGGCAGGCAGAAGGTGGAATCATCCGTATACCAGCAGTTCGAAAAACAGTTGATAGAC<br>AAACTCAATTACCTTGTAGACAAGAAGAAGCGGCCTGAGGACATAGGGGGCCTGCTTAGAGCGTATCAA<br>TTTACAGCCCCATTCAAGTCTTTCAAAGAAATGGGTAAACAGAACGGTTTTCTGTTTTACATCCCAGCGT<br>GGAACACCAGCAATATAGATCCAACCACTGGCTTCGTCAATCTGTTTCATGCTCAGTATGAAAATGTGG<br>ACAAGGCCAAATCCTTCTTTCAGAAATTTGACAGCATCTCCTATAACCCAAAGAAAGACTGGTTTGAATT<br>CGCCTTTGACTATAAGAATTTCACTAAGAAGGCCGAGGGATCAAGAAGCATGTGGATATTGTGCACGCA<br>TGGCTCACGTATAAAGAACTTTAGAACGTCGCAAAAAAACGGCAGTGGGACTCAGAAGAATTCGCACT<br>CACCGAGGCTTTCAAATCCCTCTTCGTCCGGTATGAGATCGATTACACCGCCGATCTGAAGACGGCAATC<br>GTCGACGAGAAACAGAAAGACTTCTTTGTAGATCTACTTAAGCTCTTTAAGCTAACCGTTCAGATGCGA<br>AACAGTTGGAAAGAAAAGGATCTCGACTATCTCATTAGTCCAGTGGCTGGCGCGGATGGTAGATTTTTC<br>GATACCCGGGAAGGTAACAAGTCCCTTCCCAAAGACGCCGACGCGAATGGTGCCTACAATATTGCACTA<br>AAGGGGCTCTGGGCGCTGCGGCAAATTAGACAGACATCTGAAGGGGCAAGCTTAAGCTGGCTATTTCT<br>AATAAAGAGTGGTTGCAGTTTGTGCAGGAAAGGAGTTATGAGAAGGACTAG |
| SEQ ID NO: 153 | ATGAACAACGGCACCAACAACTTCCAGAACTTCATCGGCATATCGTCTCTGCAGAAAACACTTAGGAAT<br>GCCCTGATTCAACTGAGACAACACAGCAGTTTATTGTGAAGAATGGGATCATCAAAGAGGACGAATTG<br>CGCGGGGAGAATAGGCAGATCCTGAAGGACATCATGGACGATTACTACAGGGGTTTTATCTCCGAAACG<br>CTGAGCTCGATTGACGATATTGACTGGACGTCCCTCTTTGAGAAGATGGAAATCCAACTTAAAAATGGC<br>GATAATAAAGATACCCTGATAAAGGAACAAACCGAATATAGAAAGGCTATACACAAAAAATTCGCAAA<br>TGACGACCGCTTTAAGAACATGTTTTCTGCAAAACTGATTAGCGATATTCTGCCCGAGTTTGTGATTCAC<br>AATAATAACTATTCCGCTTCGGAGAAGGAGGAAAAGACTCAGGTGATTAAACTGTTTTCTCGGTTCGCC<br>ACTTCTTTCAAAGATTATTTCAAAAATCGCGCCAACTGTTTTTCCGCTGACGACATCTCCTCCTCTTCCTG<br>CCACCGGATCGTAAACGACAATGCCGAGATCTTTTTTAGTAACGCCCTTGTGTATCGGAGGATAGTGAA<br>GAGCCTGTCCAATGATGACATAAACAAAATTTCTGGCGATATGAAGGATAGCCTCAAAGAGATGAGCCT<br>TGAAGAAATTTACTCCTACGAGAAGTATGGGGAGTTCATCACCCAGGAGGGGATTTCCTTCTATAATGA<br>CATCTGTGGCAAGGTGAACAGCTTCATGAACCTGTACTGCCAGAAGAATAAGGAAAACAAAATCTGTA<br>CAAGCTTCAGAAGTTACATAAGCAGATCCTGTGTATCGCGGATACCTCATATGAGGTTCCTTATAAGTTC<br>GAGAGTGATGAAGAAGTGTACCAGTCTGTAAATGGATTCTTAGACAATATTTCGTCCAAACATATAGTG<br>GAGAGACTGAGAAAGATCGGGGACAATTACAATGGGTACAATCTCGACAAGATTTATATCGTGTCGAAG<br>TTTTACGAATCTGTGAGCCAGAAAACATACAGGGATTGGGAAACCATTAATACCGCGCTTGAAATTCAC<br>TACAATAATATTCTGCCTGGCAACGGAAAAAGCAAGGCCGATAAGGTAAAAAAGGCAGTCAAAATGA<br>CCTTCAGAAAAGTATCACCGAAATCAATGAGTTGGTGAGCAACTACAAATTGTGTTCAGACGATAATAT<br>TAAAGCGGAAACGTACATACATGAAATTAGCCATATTCTGAATAACTTTGAGGCGCAGGAACTTAAGTA<br>CAACCCTGAAATTCATCTCGTCGAAAGCGAATTGAAGGCCTCTGAATTGAAAACGTTCTTGACGTGAT<br>AATGAACGCTTTCCATTGGTGCTCTGTGTTTATGACTGAAGAGCTGGTTGATAAGGACAACAACTTTTAT<br>GCTGACTTGAGGAAATCTACGACGAGATCTACCCTGTGATTAGCTTGTATAACCTCGTCAGAAACTAC<br>GTTACCCAGAAGCCGTACAGCACGAAAAAAATAAAGCTGAACTTTGGTATTCCGACTCTCGCCGATGGA<br>TGGAGCAAGTCGAAGGAATATTCCAACAATGCCATCATTCTTATGCGAGACAATCTGTATTACCTCGGC<br>ATCTTTAACGCCAAAAACAAGCCGGATAAGAAAATCATTGAAGGGAATACGAGCGAGAATAAGGGCGA<br>CTATAAGAAAATGATCTACAACTTACTGCCAGGTCCCAATAAAATGATTCCTAAGGTGTTTCTGTCATCG<br>AAAACAGGTGTAGAAACATATAAGCCCAGCGCATACATCCTGGAAGGCTACAAGCAAAACAAACACAT<br>CAAAAGCAGCAAGGACTTTGATATCACATTCTGCCACGATCTAATCGACTACTTCAAAAATTGCATCGCC<br>ATTCACCCTGAGTGGAAGAACTTCGGCTTTGACTTCTCCGACACCAGTACCTACGAAGACATTTCTGGAT<br>TCTACCGTGAGGTTGAGCTGCAGGGTTATAAAATTGACTGGACATACATCAGTGAAAAAGACATCGATC<br>TACTGCAGGAGAAGGGGCAGCTCTATCTCTTCCAGATTTATAATAAGGATTTCAGCAAGAAGTCCACTG<br>GAAACGACAATCTGCATACAATGTATCTTAAGAACTTGTTTAGCGAAGAGAATTTGAAAGATATCGTTC<br>TAAAGTTAAACGGGGAAGCCGAGATTTTCTTTCGAAAGTCTTCCATTAAGAATCCAATTATTCACAAGA<br>AGGGCAGTATCCTGGTCAACAGAACCTATGAGGCCGAGGAAAAGGACCAGTTCGGTAATATACAAATT<br>GTGCGCAAGAACATCCCCGAGAACATTTACCAGGAGCTCTATAAATACTTCAACGACAAAAGCGATAAG<br>GAGCTTTCCGACGAGGCTGCCAAGCTGAAAAACGTGGTGGGACACCATGAAGCAGCCACCAACATCGTC<br>AAAGATTATCGTTATACATATGACAAATATTTTCTGCACATGCCTATTACAATAAACTTTAAGGCAAACA<br>AGACCGGGTTCATCAATGACCGGATACTCCAGTACATCGCAAAAGAGAAGGACCTGCATGTGATCGGCA<br>TCGACCGCGGTGAAAGAAATCTCATTTACGTCAGCGTTATCGAACTGGAGAAACATTGTGAGAAGCAA<br>AGTCCTTCAACATTGTTAACGGCTATGACTATCAGATCAAGCTCAAACAGCAGGAAGGTGCCGTCAGA<br>TTGCGAGGAAAGAATGGAAAGAGATCGGCAAGATCAAGGAGATCAAGAAGGGTATCTGAGCTTGGTC<br>ATTCACGAGATCTCCAAAATGGTCATCAAGTACAACGCTATTATCGCGATGGAAGACCTCTCTTACGGCT<br>TTAAGAAGGGGCGCTTTAAAGTGGAGCGCCAGGTCTATCAGAAGTTCGAGACTATGCTTATCAATAAGC<br>TGAATTACTTGGTCTTTAAGGATATCAGTATCACCGAGAACGGAGGACTGCTGAAAGGTTACCAGCTCA |

| SEQ ID NO | Sequence |
|---|---|
| | CATATATTCCCGATAAGCTCAAGAATGTGGGCCACCAATGCGGTTGTATTTTTACGTTCCAGCTGCCTA<br>CACATCTAAGATCGATCCTACCACCGGATTCGTCAATATATTTAAATTTAAAGATCTAACCGTTGATGCC<br>AAGCGTGAGTTTATTAAGAAATTTGATTCAATCAGGTACGACAGCGAAAAGAACCTCTTCTGTTTCACTT<br>TCGACTACAACAACTTCATCACACAAAATACTGTGATGAGCAAGTCATCATGGAGCGTTTATACTTATGG<br>TGTAAGGATAAAAAGGCGCTTTGTTAATGGAAGGTTTTCCAATGAAAGCGATACAATAGACATCACAAG<br>AGACATGGAGAAGACACTGGAGATGACAGATATTAATTGGAGGGACGGGCATGACCTTAGACAGGACA<br>TCATCGACTACGAAATCGTCCAACACATTTTTGAGATATTCAGACTCACTGTCCAGATGCGAAACAGCCT<br>GTCGGAACTCGAAGACCGGGACTACGATAGACTGATCTCCCCGGTGTTAAACGAAAATAATATTTTCTA<br>CGATTCTGCTAAGGCAGGAGACGCTCTTCCTAAAGATGCGGACGCCAATGGCGCTTACTGTATAGCGTT<br>GAAGGGATTGTATGAGATTAAACAGATCACTGAGAATTGGAAAGAAGACGGTAAATTCTCCAGAGACA<br>AGCTGAAAATCTCCAACAAAGACTGGTTTGATTTTATTCAAATAAGCGCTACCTGTAA |
| SEQ ID NO: 154 | ATGACAAACAAATTTACTAATCAGTACAGCCTGTCAAAGACCCTCCGCTTCGAACTGATTCCACAAGGG<br>AAGACCCTTGAATTCATCCAGGAAAAGGGTTTATTATCCCAGGATAAACAACGCGCAGAAAGCTATCAA<br>GAGATGAAGAAGACGATCGATAAATTTCATAAGTATTTCATAGATTTAGCCCTGAGCAACGCTAAATTG<br>ACCCACCTGGAAACCTATTTGGAGCTGTACAACAAGTCAGCCGAGACAAAGAAAGAGCAGAAGTTTAA<br>GGACGACCTGAAAAAAGTACAGGACAATTTGCGAAAAGGATCGTCAAGTCTTTTTCCGACGGAGACGC<br>CAAGTCAATATTTGCCATCCTGGACAAAAAGGAACTCATCACTGTGGAGTTGGAGAAGTGGGTTTGAGAA<br>TAATGAGCAGAAGGACATCTATTTTGACGAAAAGTTCAAGACATTTACTACTTACTTCACCGGATTTCAC<br>CAAAACCGGAAGAACATGTACTCTGTTGAGCCGAACTCAACCGCCATCGCCTACCGCCTTATTCACGAA<br>AATCTGCCAAAGTTTCTCGAGAATGCTAAAGCCTTTGAGAAAATTAAGCAGGTCGAGTCGCTCCAGGTG<br>AACTTTCGAGAGCTGATGGGTGAATTCGGGGACGAGGGCCTGATTTTCGTGAATGAACTCGAAGAGATG<br>TTTCAGATCAACTACTATAATGATGTACTCTCACAGAACGGGATCACTATCTACAACAGCATTATCTCTG<br>GATTCACTAAGAACGATATCAAGTATAAAGGGCTGAATGAATACATCAACAATTATAATCAGACTAAGG<br>ACAAAAAGGACAGGCTGCCTAAATTGAAACAGCTGTATAAGCAGATCCTCAGTGATAGAATTAGCTTGT<br>CATTTCTCCCAGATGCCTTCACTGACGAAAGCAGGTGCTTAAGGCGATATTCGATTTCTATAAGATCAA<br>CCTCCTCTCTTATACAATCGAGGGCCAGGAGGAGTCACAGAACCTCCTGCTCCTGATTCGACAAACTATT<br>GAAAATCTGTCCTCTTTCGATACGCAGAAGATATACCTGAAAAATGACACCCATCTCACTACAATATCCC<br>AACAGGTATTCGGAGATTTCTCCGTCTTCAGTACAGCCCTGAATTACTGGTACGAGACAAAGGTGAACC<br>CTAAGTTCGAAACAGAGTACAGCAAGGCGAACGAAAAGAAGAGGGAGATCCTGGACAAAGCCAAAGC<br>CGTTTTCACCAAGCAAGATTACTTTAGCATCGCATTTCTGCAGGAAGTCCTGTCTGAGTACATACTGACA<br>CTCGATCACACAAGCGACATAGTTAAGAAGCACTCTTCCAATTGTATCGCGGACTACTTCAAAAATCATT<br>TTGTCGCGAAAAAGGAGAACGAGACAGATAAGACCTTCGATTTTATCGCGAATATTACCGCAAAGTATC<br>AATGCATTCAGGGTATCTTGGAGAACGCCGACCAGTACGAAGCGCTTAAACAGGATCAGAAGCTC<br>ATCGACAACCTAAAGTTCTTTTTGGACGCTATACTGGAACTCCTTCATTTTATTAAGCCACTACATCTGA<br>AGAGTGAGTCTATCACTGAGAAGGACACTGCTTTTTACGACGTTTTCGAGAATTACTACGAAGCACTGTC<br>TCTGCTAACCCCTCTGTATAACATGGTGAGAAACTATGTGACACAGAAACCTTATAGTACCGAGAAGAT<br>TAAGTTGAACTTCGAGAACGCACAATTGCTGAATGGGTGGGATGCAAACAAAGAGGGTGATTACCTCAC<br>AACAATCCTCAAGAAAGATGGCAATTACTTCCTGGCCATTATGGATAAAAACATAACAAGGCATTTCA<br>GAAATTTCCCGAGGGGAAGGAAATTATGAAAGATGGTATACAAGTTGCTGCCCGGGGTGAACAAAA<br>TGCTCCCGAAGGTGTTTTTCTCGAATAAGAATATCGCGTACTTTAACCCGTCCAAGGAACTGTTGGAAAA<br>TTATAAAAAGGAAACACACAAGAGGGGGACACTTTTAATTTGGAGCACTGCCACACACTGTTGACTT<br>CTTTAAAGATAGTCTCAACAAACATGAGGATTGGAAATATTTTGACTTTCAGTTTAGCGAGACCAAGTCT<br>TATCAGGATCTGTCGGGATTTTATAGGGAAGTTGAGCACCAGGGTTACAAGATAAATTTCAAGAACATC<br>GATAGCGAGTACATTGACGGACTGGTGAACGAAGGGAAGCTGTTCCTGTTTCAGATTTACAGCAAAGAT<br>TTCTCTCCTTTCTCAAAAGGCAAGCCGAACATGCATACCCTGTATTGGAAGGCCCTGTTCGAGGAGCAAA<br>ACCTTCAGAATGTGATTTACAAGCTGAACGGTCAGGCCGAGATTTTTTTAGGAAGGCCTCTATCAAGCC<br>CAAAAACATCATTCTGCAAGAAAAAGATAAAGATCGCCAAAAACACTTCATTGATAAAAAGACAA<br>AGACTTCTGAGATCGTACCTGTTCAGACAATCAAGAATCTCAACATGTATTATCAGGGGAAGATTAGCG<br>AGAAAGAGCTGACACAGGACGATTTGAGGTACATCGACAACTTCTCTATCTTTAACGAGAAGAACAAGA<br>CAATCGATATCATCAAGGACAAGCGGTTTACCGTCGATAAATTCCAGTTCCATGTGCCTATCACGATGAA<br>TTTCAAGGCCACCGGTGGGAGTTATATCAACCAGACTGTGCTGGAGTATTGCAGAACAACCCCGAAGT<br>AAAAAATTATTGGCCTGGACAGAGGAGAGCGGCATCTGGTGTACTTGACCCTCATCGATCAGCAGGGAAA<br>TATCCTGAACAAGAATCTCTGAATACTATTACGGACTCCAAAATCACCACCTTACCACAAGCTGCTT<br>GATAATAAAGAGAATGAGAGGGACTTGGCCCGCAAAAATTGGGGCACCGTCGAGAATATTAAGGAATT<br>GAAAGAAGGATACATCTCACAGGTGGTTCACAAAATCGCAACCCTGATGTTAGAAGAGAACGCTATTGT<br>GGTGATGGAGGACTTAAACTTCGGATTTAAAAGAGGAAGATTTAAAGTCGAGAAACAGATTTATCAGAA<br>ACTGGAAAAAATGCTCATTGACAAATTAAATTACCTGGTGCTGAAGATAAACAGCCACAGGAGCTGGG<br>TGGCCTGTATAATGCTCTGCAGCTGACCAACAAGTTCGAGTCGTTTCAGAAAATGGGCAAGCAGTCAGG<br>CTTCCTTTTTTACGTGCCCGCTTGGAACACCTCAAAAATCGACCCTACAACAGGCTTTGTGAATTATTCT<br>ATACCAAGTATGAAACGTGGACAAGGCAAAGGCCTTTTTCGAAGAGTTTGAAGCAATCAGGTTCAATG<br>CCGAGAAAAATACTTTGAGTTCGAGGTCAAAAAATATAGCGACTTCAACCCTAAGGCCGAAGGCACGC<br>AACAAGCCTGGACAATATGCACGTATGGGGAGAATTAGCTAAGCGGCAGAAGGATCAGAATAAC<br>AAATTCGTGAGCACACCGATTAACCTGACAGAGAAGATAGAGGACTTCCTCGGCAAGAATCAGATCGTG<br>TACGGCGACGGCAATTGCATCAAGTCACAAATTGCATCTAAAGATGACAAAGCATTCTTCGAAACACTG<br>CTGTATTGGTTCAAGATGACACTCCAGATGCGAAATAGCGAAACAAGAACAGATATTGACTACCTCATC<br>AGCCCTGTGATGAATGATAACGCACGTTTTACAATTCCCGGGACTATGAAAAATTAGAGAACCCGACA<br>CTGCCAAAAGACGCCGACGCAAATGGTGCATATCACATCGCAAAGAAAGGTTTGATGCTGTTGAACAAA<br>ATTGATCAGGCTGATCTGACAAAAAAAGGTCGATCTGAGTATCAGTAACCGCGACTGGTTGCAGTTTGTC<br>CAGAAGAACAAATAA |
| SEQ ID NO: 155 | ATGGAACAAGAGTACTATCTGGGCCTGGACATGGGCACCGGGAGTGTCGGATGGGCAGTCACCGACTCA<br>GAGTACCACGTCCTCAGAAAGCACGGTAAGGCACTTTGGGGAGTGCGACTCTTCGAGTCCGCTAGTACT<br>GCTGAAGAGGAGGATGTTTCGAACTTCCAGGCGCAGGCTGGATCGGCGAAACTGGAGAATAGAGAT<br>TCTCCAGGAGATATTTGCTGAAGAGATTTCAAAGAAGGATCCTGGTTTTTTCCTGCGCATGAAAGAATCT<br>AAGTATTACCCCGAAGATAAACGCGACATCAACGGCAATTGTCCTGAACTGCCCTATGCTCTGTTTGTCG |

| SEQ ID NO | Sequence |
|---|---|
| | ACGACGATTTCACCGACAAAGATTACCACAAGAAATTCCCCACCATATACCACCTGAGAAAGATGTTGA<br>TGAACACCGAGGAGACACCCGACATACGTCTGGTTTACCTGGCTATCCATCATATGATGAAGCACCGCG<br>GGCATTTCCTGCTGTCTGGAGACATCAATGAGATAAAGGAATTTGGTACTACGTTCTCCAAGTTGTTAGA<br>AAACATTAAGAATGAAGAGTTGGACTGGAATCTTGAACTGGGAAAGGAAGAGTATGCAGTTGTAGAGT<br>CGATTTTGAAAGATAACATGTTAAACCGGTCAACTAAGAAAACCAGGTTAATTAAGGCACTAAAAGGCCA<br>AATCGATATGCGAGAAGGCTGTGCTAAATCTGCTGGCTGGAGGCACCGTGAAACTGTCTGATATTTTCG<br>GCCTGGAAGAGCTCAATGAAACCGAGCGGCCTAAAATTTCTTTCGCCGATAACGGATACGATGACTATA<br>TTGGGGAGGTGGAAAACGAGCTCGGAGAACAATTCTACATTATTGAAACCGCTAAGGCAGTCTATGACT<br>GGGCCGTGCTCGTCGAGATTTTAGGCAAGTACACCAGCATTAGCGAAGCAAAGGTGGCTACCTATGAAA<br>AGCACAAATCTGACCTCCAGTTTCTGAAAAAGATTGTGCGCAAATACTTAACAAAAGAAGAGTACAAGG<br>ACATCTTTGTGAGCACATCAGATAAGCTCAAGAATTACTCAGCATACATTGGAATGACAAAGATTAACG<br>GGAAGAAGGTGGATCTCCAAAGCAAACGTTGTTCAAAGGAGGAGTTTTACGATTTCATAAAGAAGAAC<br>GTGCTGAAGAAACTGGAGGGACAACCGGAGTACGAGTATTTAAAGGAGGACTCGAGCGAGAAACTTT<br>CCTGCCCAAGCAAGTGAACAGAGACAATGGTGTCATTCCTTACCAGATTCACTTATATGAGCTGAAGAA<br>AATCCTGGGGAACTTGAGAGACAAGATAGACCTCATCAAGGAAAATGAAGATAAGTTGGTCCAGTTGTT<br>CGAATTCAGAATCCCATATTACGTCGGCCCGCTCAATAAGATCGACGACGGCAAGGAAGGCAAATTCAC<br>TTGGGCGGTGCGAAAAAGCAACGAAAAAATATACCCATGGAACTTTGAGAACGTCGTTGACATCGAGG<br>CCAGCGCCGAGAAATTTATAAGACGCATGACTAATAAGTGTACTTACCTCATGGGCGAGGATGTTCTGC<br>CCAAGGACAGCCTGCTGTATTCCAAGTACATGGTGCTTAACGAGCTGAATAATGTAAAGTTAGATGGTG<br>AGAAGCTCAGCGTGGAGCTTAAACAGAGGCTGTACACTGATGTGTTTTGCAAGTATCGGAAAGTTACCG<br>TTAAGAAGATAAAGAATTACCTGAAATGCGAAGGGATCATTTCCGGCAACGTGGAAATTACCGGAATCG<br>ACGGCGATTTTAAGGCGTCGTTGACCGCTTATCATGATTTCAAGGAGATTTTAACCGGCACGGAGCTCGC<br>GAAGAAAGACAAGGAGAACATAATCACGAATATAGTTCTGTTTGGGACGATAAAAAACTTCTTAAAA<br>AACGACTCAATCGACTGTATCCGCAGATTACCCCCAACCAGCTGAAGAAGATTTGCGCTCTGAGCTATA<br>CCGGGTGGGGCCGGTTCTCTAAGAAATTCCTCGAGGAGATCACAGCACCCAGACCCAGAGACTGGTGAGG<br>TGTGGAATATTATTCAGCTCTGTGGGAATCCAATAATAACCTTATGCAATTGTTGAGCAATGAATATAG<br>GTTCATGGAGGAAGTGGAAACCTACAATATGGGCAAGCAGACAAAGACCCTATCTTACGAGACCGTTGA<br>GAATATGTATGTCTCCCCTTCAGTGAAACGGCAAATCTGGCAAACTTTGAAGATCGTGAAGGAGCTCGA<br>AAAGGTGATGAAAGAGAGCCCGAAGAGGGTTTTTATTGAAATGGCCAGAGAAAACAGGAGAGCAAGA<br>GAACAGAGTCTAGGAAGAAGCAGCTAATCGATTTGTATAAAGCCTGCAAGAACGAGGAAAAAGACTGG<br>GTCAAGGAGCTAGGCGATCAGGAAGAACAGAAGTTGCGCTCTGATAAGCTGTACTTATATTATACCCAG<br>AAAGGACGGTGCATGTACTCAGGTGAGGTCATTGAGCTGAAAGATCTGTGGGACAATACTAAGTATGAT<br>ATTGATCACATCTACCCTCAGTCAAAAACTATGGACGACTCCCTCAACAACAGGGTGTTGGTTAAGAAG<br>AAATACAATGCTACAAAGTCCGATAAATACCCTCTTAACGAAAACATCCGGCACGAAAGAAAGGGCTTC<br>TGGAAGTCCCTGCTGGATGGGGGTTTTATCAGTAAAGAAAAGTATGAGAGGCTGATCCGAAATACCGAG<br>CTCTCCCCCGAGGAACTGGCTGGCTTTATCGAAAGGCAGATCGTAGAGACTAGGCAATCTACAAAGGCA<br>GTCGCTGAGATCCTGAAGCAAGTGTTTCCTGAGTCAGAAATCGTGTACGTCAAAGCTGGCACAGTGTCA<br>CGGTTCCGAAAGGACTTTGAGTTGTTAAAAGTTCGGGAGGTGAATGACCTGCACCACGCTCAAAGACGCC<br>TATCTGAATATCGTTGTGGGAACTCCTATTATGTTAAGTTTACTAAGAATGCGTCCTGGTTTATTAAGG<br>AGAACCCGGGGCGCACCTATAACCTGAAGAAGATGTTCACCTCCGGCTGGAACATAGAACGGAACGGA<br>GAAGTCGCGTGGGAGGTGGGTAAGAAAGGGACCATTGTGACCGTCAAACAGATTATGAACAAAAACAA<br>CATATTGGTAACTCGCCAGGTGCATGAGGCCAAAGGGGGCCTCTTTGATCAGCAGATTATGAAAAAGGG<br>CAAAGGACAGATCGCAATCAAGGAAACCGACGAGCGCCTGGCATCCATTGAGAAGTACGGAGGCTACA<br>ACAAGGCGGCAGGTGCGTACTTCATGCTCGTCGAGTCCAAAGATAAGAAAGGCAAAACTATTAGAACA<br>ATCGAGTTCATCCCTCTATATTTGAAAAATAAGATCGAAAGTGACGAAAGCATCGCCCTTAACTTCTTGG<br>AGAAGGGCCGGGGCTTAAAGGAACCAAAGATTCTGCTCAAGAAGATCAAGATCGACACACTCTTCGAT<br>GTGGATGGTTTTAAGATGTGGCTGTCAGGCAGGACAGGGGATCGCTTGCTGTTCAAATGCGCAAATCAG<br>TTGATTCTGGACGAAAAGATCATTGTGACGATGAAGAAGATCGTTAAATTCATTCAGCGGAGACAGGAA<br>AACAGAGAACTGAAACTCTCCGATAAGGATGGAATTGACAATGAAGTCCTCATGGAGATTTACAATACC<br>TTTGTGGACAAGCTTGAGAACACAGTCTATCGGATCCGATCCTGATCGAC<br>AAACAGAAAGAATTCGAAAGACTAAGCTTAGAGGACAAAAGTTCAACTCTCTTTGAAATTCTCCACATC<br>TTCCAATGTCAAAGTAGTGCAGCCAACTTGAAGATGATCGGGGGTCCCGGCAAGGCTGGAATCTTAGTC<br>ATGAACAACAACATCTCCAAATGTAACAAAATCTCCATCATAAACCAGTCTCCCACCGGCATTTTCGAG<br>AACGAAATTGATTTACTCAAG |
| SEQ ID NO: 156 | ATGAAATCTTTCGATTCTTTCACCAACCTCTACTCCCTTAGCAAAACCCTTAAGTTTGAAATGAGGCCGG<br>TGGGGAATACACACGAAGATGCTTGACAATGCTGGCGTCTTTGAAAAGGACAAATTAATCCAGAAGAAGT<br>ATGGTAAAACAAAGCCATATTTTGACCGATTGCATCGGGAATTCATTGAAGAGGCTCTTACAGGAGTAG<br>AATTGATCGGACTGGACGAGAACTTCCGTACCTTAGTAGACTGGCAGAAGGACAAGAAGAACAACGTG<br>GCAATGAAGGCCTATGAGAACTCACTCCAGCGCCTTAGAACGCGAGATCGGAAAGATCTTTAATCTTAAG<br>GCGGAAGATTGGGTAAAAAATAAGTACCCGATCCTGGGACTGAAAAACAAAACACAGACATCCTGTT<br>TGAAGAAGCCGTCTTTGGTATCTTGAAGGCCAGGTATGGAGAGGAGAAAGACACGTTTATAGAGGTAGA<br>GGAGATTGATAAAACAGGCAAGAGTAAGATTAATCAGATCATTTCTTTGATTCTTGGAAGGGGGGTTCAC<br>AGGCTACTTTAAGAAGTTTTTCGAAACCAGGAAAAATTTCTATAAGAACGATGGCACCTCCACAGCTAT<br>CGCGACACGCATCATAGATCAGAATCTGAAACGGTTCATTGATAATCTGAGCATTGTTGAATCCGTGCG<br>CCAGAAGGTCGACCTAGCTGAGACTGAGAAGTCTTTCTCTATATCACTCTCCCAGTTCTTTCTCAATAGAT<br>TTTTATAATAAGTGCCTTCTGCAAGATGGCATAGACTACTATAACAAGATCATCGGCGGAAACTCTCA<br>AAAACGGTGAAAAGCTCATTGGCCTGAATGAGCTCATCAACCAATATAGACAAAATAACAAGGATCAG<br>AAAATCCCATTCTTTAAGCTGCTAGATAAACAGATCCTATCAGAAAAAATCCTGTTCCTCGACGAAATCA<br>AAAACGACACCGAACTCATCGAGGCTCTCTCGCAGTTTGCCAAGACGGCTGAGGAGAAGACGAAGATT<br>GTGAAAAGCTGTTTGCAGACTTTGTGGAGAACAACTCTAAATACGATTTGGCTCAGATTTATATCTCCC<br>AGGAAGCATTTAACACAATCTCCAATAAGTGGACTAGCGAGACTGAAACCTTCGCCAAATACCTGTTCG<br>AGGCCATGAAAGCGGCAAGCTCGCCAAATACGAGAAGAAGGACAATTCCTATAAGTTTCCCGATTTCA<br>TCGCATTATCTCAGATGAAGTCCGCGCTACTTAGCATTAGCCTGGAAGGCCATTTTTGGAAGGAGAAAT<br>ACTATAAGATTTCCAAATTCCAAGAAAAGACCAATTGGGAGCAGTTCTTGGCTATTTTTCTATACGAGTT<br>CAACTCTTTGTTCAGTGACAAGATCAACACTAAGGACGGTGAGACCCAAACAGTGGGGTACTACCTCTT |

TABLE 5-continued

| SEQ ID NO | Sequence |
|---|---|
| | CGCCAAAGATCTTCATAACCTGATACTGTCCGAACAGATCGACATACCCAAGGATTCAAAGGTGACCAT<br>CAAGGATTTTGCGGATTCGGTATTGACGATCTATCAGATGGCGAAGTATTTCGCTGTCGAGAAAAAGCG<br>GGCATGGCTGGCCGAATACGAGTTGGACTCCTTCTATACTCAACCCGATACAGGGTACCTGCAGTTTTAC<br>GATAATGCATACGAGGATATAGTCCAGGTGTACAATAAACTCAGGAACTACCTCACTAAGAAACCATAC<br>TCCGAAGAAAAATGGAAACTTAATTTTGAGAATAGTACACTGGCCAATGGATGGGACAAGAACAGGA<br>ATCAGACAACTCCGCTGTAATTCTCCAGAAGGGTGGCAAGTATTATCTGGGACTGATAACAAAGGGCCA<br>TAACAAGATTTTCGATGACCGTTTTCAGGAGAAGTTTATAGTGGGCATAGAGGGTGGCAAGTATGAAAA<br>AATAGTCTACAAGTTCTTTCCCGATCAGGCGAAGATGTTCCCCAAAGTATGCTTCAGTGCTAAAGGCCTC<br>GAGTTTTTCCGGCCATCTGAAGAGATACTCCGCATCTATAATAACGCAGAGTTTAAAAAGGGAGAGACG<br>TACTCAATCGACTCGATGCAGAAACTCATTGACTTCTACAAAGATTGTCTCACAAAATACGAGGGCTGG<br>GCTTGCTACACGTTTCGGCACTTGAAGCAACCGAGGAATATCAAAACAACATCGGGGAGTTCTTCCGT<br>GACGTCGCCGAAGACGGCTATAGAATTGACTTTCAGGGCATAAGTGATCAGTATATTCACGAGAAGAAT<br>GAGAAAGGTGAGTTGCATCTTTTCGAAATCCACAATAAAGACTGGAATCTTGACAAGGCTCGCGATGGA<br>AAATCAAAGACTACCCAGAAGAATCTTCATACACTTTACTTCGAGTCCCTCTTTTCCAACGACAACGTCG<br>TACAGAATTTCCCAATAAACTGAACGGCCAGGCCGAAATTTTTTACAGGCCCAAAACCGAAAAGATA<br>AACTGGAATCCAAGAAAGACAAGAAGGGAAATAAGGTGATAGATCACAAAAGGTATTCCGAGAACAAG<br>ATTTTTTTCCACGTACCTCTTACCCTGAACAGAACGAAGAACGACTCTTATAGATTCAATGCCCAGATAA<br>CAACTTTCTCGCAAACAACAAAGATATCAATATTATCGGCGTCGATAGAGGTGAGAAGCACTTGGTAT<br>ATTATTCTGTGATCACGCAAGCATCCGATATCTTGGAGTCCGGTTCTTTGAACGAACTGAATGGTGTCAA<br>CTACGCCGAGAAACTCGGTAAGAAAGCTGAGAATCGGGAGCAGGCTAGAAGGGACTGGCAGGACGTTC<br>AGGGTATCAAGGACCTGAAGAAGGGCTACATTTCTCAGGTGGTTCGAAAACTGGCTGATTTGGCCATTA<br>AGCACAATGCAATCATCATTTTAGAAGATTTGAACATGCGGTTTAAACAAGTCAGGGGGGGGATAGAGA<br>AATCAATTTACCAACAGCTGGAAAAAGCTCTGATTGATAAACTCTCTTTTTTGGTTGATAAGGGCGAAAA<br>GAACCCCGAGCAAGCAGGACATCTCCTTAAAGCCTATCAACTGAGCGCACCTTTCGAGACATTCCAGAA<br>GATGGGAAAGCAAACCGGCATCATTTTCTATACCCAGGCTTCCTATACATCCAAGTCTGATCCAGTGACT<br>GGGTGGAGACCCCATCTCTACCTCAAGTACTTTTCTGCCAAAAAAGCTAAGGACGACATTGCTAAGTTC<br>ACAAAAATCGAGTTCGTGAACGACAGGTTCGAGCTGACTTATGACATAAAAGATTTCCAGCAGGCCAAG<br>GAGTACCCAAACAAGACAGTTTGGAAAGTGTGTTCCAATGTGGAGAGGTTTCGGTGGGACAAGAATCTG<br>AATCAGAATAAAGGGGGATATACTCACTACACCAACATTACCGAGACATCCAAGAGTTGTTCACCAAA<br>TACGGCATCGACATTACTAAAGATCTGCTGACACAGATCTCCACCATCGATGAGAAGCAGAACACATCT<br>TTCTTCCGGGATTTCATCTTTTATTTTAACTTGATCTGTCAGATTAGAAATACCGACGACAGTGAGATAG<br>CTAAAAAAACGGGAAAGACGATTTCATTCTCTCCCGTGGAGCCGTTTTTTGACTCCCGCAAAGACA<br>ATGGCAATAAGCTTCCGGAAAACGGGGACGATAACGGCGCCTACAACATCGCTCGTAAGGGAATCGTTA<br>TCCTCAATAAAATAAGCCAGTATTCCGAGAAGAACGAGAATTGTGAAAAAATGAAGTGGGGGGACCTTT<br>ACGTCAGCAACATCGATTGGGATAACTTTGTGACACAAGCCAATGCGAGACACTAG |
| SEQ ID NO: 157 | ATGGAAAACTTCAAAAACCTCTACCCCATCAACAAGACCTTGAGGTTTGAGCTCCGGCCATATGGGAAG<br>ACACTGGAACTTCAAAAAGTCCGGTCTGCTGGAAAAGGATGCTTTTAAGGCTAACTCTAGGAGGTCT<br>ATGCAGGCCATTATCGATGAGAAATTCAAGGAGACCATAGAGGAGCGTCTGAAATATACTGAGTTTTCC<br>GAGTGTGACCTAGGAAATATGACCAGTAAGGACAAAAGATCACCGACAAGGCAGCGACAAACCTGAA<br>GAAACAGGTGATTTTAAGCTTTGATGATGAGATTTTCAATAACTACTTGAAGCCGGACAAAAACATCGA<br>CGCTCTGTTCAAGAATGATCCAAGCAACCCGGTCATCTCTACTTTCAAGGGCTTCACCACATACTTTGTA<br>AATTTCTTCGAAATACGGAAACACATCTTCAAGGGAGAGTCTTCCGGTAGCATGGCTTACAGAATAATC<br>GATGAGAACCTAACTACATATCTAAACAATATCGAGAAGATCAAGAAATTGCCTGAAGAACTGAAATCT<br>CAGCTTGAGGGAATCGATCAAATTGACAAACTGAACAACTATAACGAGTTCATCACCCAGTCCGGCATT<br>ACTCATTATAACGAAATTATTGGAGGGATTTCGAAGTCTGAAAATTGTCAAAATTCAAGGCATTAACGAA<br>GGGATTAATCTTTACTGTCAAAAGAATAAAGTGAAGCTACCACGCTTAACTCCTCTGTATAAGATGATTC<br>TCTCTGATCGGGTCTCTAATTCCTTTGTGCTGGATACCATTGAAATGATACCGAGTTAATTGAAATGAT<br>CTCTGATCTGATAAATAAGACAGAGATAAGTCAGGATGTTATTATGTCCGACATCCAAAATATTTTCATC<br>AAATATAAACAACTCGGCAACTTGCCGGGGATTAGCTACTCACTCTATAGTGAATGCTATCTGTTCGGATT<br>ACGACAATAACTTTGGTGACGGCAAACGTAAAAAAAGCTATGAGAATGATCGCAAAAAACACCTCGAG<br>ACTAACGTGTATAGCATTAACTATATCTCAGAGTTACTGACAGACACCGACGTCTCCAGCAACATAAAG<br>ATGCGGTACAAAGAGCTGGAGCAGAATTATCAGGTATGCAAGGAAAATTTCAACGCCACTAACTGGATG<br>AACATCAAAAACATTAAGCAGTCTGAGAAAACCAATCTGATCAAGGACCTTCTTGACATCCTCGAAGAGC<br>ATCCAGCGGTTTATGATTTGTTTGACATCGTGGATGAAGACAAAAATCCTAGTGCTGAGTTCTATACCT<br>GGCTGTCTAAAAACGCGGAGAAACTGGACTTCGAGTTTAATTCAGTGTACAACAAGAGCAGGAACTACC<br>TCACGAGAAAGCAGTACTCCGATAAAAAGATTAAGTTGAACTTCGATAGTCCTACTCTCGCCAAGGGGT<br>GGGATGCGAACAAAGAAATTGATAATAGCACAATTATCATGAGGAAGTTCAACAACGACCGGGGCGAT<br>TACGATTACTTCTTGGGGATCTGGAATAAGAGCACACCTGCCAACGAAAAGATCATCCCATTAGAGGAT<br>AATGGACTGTTTGAAAAATGCAATATAAGCTGTATCCCGATCCTAGTAAAATGCTGCCAAAGCAATTC<br>CTTTCTAAGATCTGGAAAGCTAAACATCCAACTACACCCGAGTTTGATAAGAAGTACAAAGAAGGTCGG<br>CACAAGAAGGGGCCTGATTTTGAGAAAGAGTTTCTGCACGAGTTGATCGATTGCTTTAAGCATGGATTG<br>GTAAACACGACGAAAAATATCAGGATGTGTTCGGGTTCAATCTGCGACACAACGGAAGACTACAACTCT<br>TATACAGAGTTTCTGAGGACGTCGAAAGGTGCAACTATAATCTTAGTTTCAATAAAATCGCTGACACG<br>TCTAACTTGATAAATGATGGGAAACTCTATGTTTTTCAGATCTGGAGCAAGGATTTCAGCATAGATAGCA<br>AGGGAACAAAAACTTGAACACAATATACTTTGAATCCCTCTTCTCGGAGGAAAATATGATCGAGAAGA<br>TGTTCAAGCTCTCAGGGGAAGCCGAAATATTCTATCGTCCAGCAAGTTTGAATTATTGTGAAGATATTAT<br>CAAGAAGGGACACCACCACGCCGAACTGAAGGACAAATTCGACTATCCCATCATCAAGGACAAGCGAT<br>ATAGCCAGGACAAATTTTTTTTCATGTCCCATGGTTATCAACTACAAAGCGAGAAGTTAAACTCCAA<br>ATCACTTAACAATAGGACGAACGAAATTTAGGCCAATTCACGCACATCATCGGTATCGACCGCGGAGA<br>GCGACATCTCATCTACCTGACCGTGGTGGATGTGTCCACCGGTGAGATCGTTGAGCAAAAGCACCTGGA<br>TGAAATTATAAATACAGATACAAAAGGCGTCGAGCATAAAACTCATTATCTCAATAAATTAGAAGAGAA<br>GTCCAAGACGCGGGATAATGAAAGAAAGTCCTGGGAAGCAATCGAGACGATTAAGGAGCTGAAAGAAG<br>GCTATATTAGCCACGTGATCAATGAAATCCAGAAATTGCAGGAAAAGTATAACGCACTGATAGTGATGG<br>AGAACCTCAATTATGGGTTTAAGAACTCGCGTATCAAAGTGGAAAAGCAGGTCTACCAGAAATTCGAGA<br>CCGCCCTGATTAAAAAGTTTAATTACATCATTGACAAGAAAGATCCTGAAACCTACATTCATGGATACC |

TABLE 5-continued

| SEQ ID NO | Sequence |
|---|---|
| | AACTGACGAATCCAATCACTACACTCGATAAAATTGGTAACCAGAGCGGTATTGTGTTGTACATTCCGG<br>CTTGGAATACAAGCAAGATTGATCCAGTCACTGGTTTCGTTAACCTCCTGTATGCAGACGATTTGAAATA<br>CAAGAACCAGGAGCAGGCTAAAAGCTTTATCCAGAAAATCGATAATATCTACTTCGAAAATGGTGAGTT<br>TAAATTTGATATAGATTTCAGCAAATGGAACAACCGCTACTCAATTAGCAAGACGAAATGGACACTGAC<br>AAGCTACGGAACCCGGATACAGACGTTCCGAAACCCCCAGAAAAATAACAAGTGGGACAGCGCCGAGT<br>ATGACCTGACCGAAGAGTTTAAATTAATCCTGAACATCGATGGTACTCTGAAATCTCAGGATGTGGAAA<br>CCTATAAGAAATTCATGTCTTTATTCAAGCTGATGTTGCAGCTGCGAAACTCCGTTACTGGAACAGACAT<br>TGACTACATGATTAGCCCTGTGACAGATAAAACTGGAACCCACTTTGATTCACGGGAGAATATCAAGAA<br>CCTGCCCGCCGATGCTGATGCGAACGGAGCTTACAACATTGCTAGGAAGGGCATCATGGCAATCGAGAA<br>TATTATGAACGGCATTAGCGACCCTCTGAAGATCAGTAATGAGGACTACCTGAAGTACATTCAGAACCA<br>ACAAGAGTAA |
| SEQ ID NO: 158 | ATGACCCAGTTTGAGGGTTTCACCAATCTTTATCAGGTGTCAAAAACACTCAGATTTGAGCTCATCCCAC<br>AGGGTAAAACTTTAAAGCATATTCAAGAGCAGGGCTTTATAGAGGAAGACAAAGCCAGAAACGACCAT<br>TATAAGGAACTAAAACCGATCATTGACCGCATCTACAAAACCTATGCCGACCAATGCCTTCAGCTCGTC<br>CAACTCGATTGGGAGAATCTGAGCGCCGCTATTGACAGCTACAGGAAGGAGAAGACCGAGGAGACTAG<br>AAACGCCCTGATCGAGGAGCAGGCGACCTATAGAAACGCTAATCGACGATTATTTTATCGGCCGCACCGA<br>CAATTTGACAGATGCCATCAACAAGCGGCACGCCGAAATTTATAAGGGGTTATTTAAGGCCGAGCTGTT<br>CAATGGAAAAGTACTGAAACAGCTGGGCACCGTAACAACCACCGACACGAGAATGCTCTGTTGAGGT<br>CCTTCGACAAGTTTACTACCTACTTTAGCGGCTTCTACGAAAACCGTAAAAACGTGTTTTCCGCGGAGGA<br>TATTTCAACAGCCATTCCTCATAGGATCGTGCAGGATAATTTCCCAAGTTTAAGGAGAACTGCCATATC<br>TTTACCAGACTTATCACTGCTGTGCCAAGTTTACGAGAACACTTCGAGAATGTTAAGAAGGCTATAGGC<br>ATATTCGTTTCCACCTCCATCGAAGAAGTATTCAGTTTTCCATTCTACAATCAGTTACTCACGCAGACCC<br>AGATAGATCTCTACAATCAGCTGCTCGGAGGCATTTCTAGAGAAGCAGGCACGGAAAAGATCAAGGGCT<br>TAAATGAAGTACTCAATCTTGCAATTCAGAAGAACGATGAGACAGCACACATTATTGCATCTCTCCCTCA<br>CAGATTCATTCCCCTGTTCAAACAGATCCTGTCCGATCGCAACACACTAAGCTTTATACTTGAGGAGTTT<br>AAGTCAGATGAGGAAGTGATCCAGAGCTTCTGTAAGTATAAGACTTTGCTCCGTAATGAAAACGTGCTT<br>GAGACAGCAGAGGCTCTCTTTAACGAGTTGAATTCCATCGACCTGACACACATTTTTATCAGCCATAAAA<br>AGCTGGAAACGATTAGCTCTGCCTTGTGCGACCACTGGGACACCCTGCGTAACGCCCTCTATGAAAGGC<br>GCATTTCCGAGCTCACCGGGAAGATCACAAAAAGTGCCAAGGAAAAGTCCAGAGGTCCCTTAAACAT<br>GAAGACATCAACCTACAAGAGATCATCTCTGCGGCTGGGAAAGAGCTGTCAGAAGCATTTAAACAGAA<br>GACTTCCGAGATCCTGAGCCACGCACACGCCGCATTAGACCAGCCCCTGCCTACAACTCTTAAAAAACA<br>GGAGGAGAAGGAGATTTTAAAGAGCCAGCTGGACTCATTACTGGCCTGTATCATCTCCTGGACTGGTT<br>CGCCGTGGACGAATCCAACGAGGTGGACCCAGAATTTAGCGCCCAGGCTGACAGGAATTAAACTGGAAA<br>TGGAGCCAAGTTTGAGCTTTTACAACAAGGCTCGGAACTATGCCACTAAAAAGCCCTACAGCGTGGAAA<br>AGTTCAAGCTGAATTTTCAGATGCCGACCCTGGCTTCCGGGTGGGATGTTAATAAGGAAAGAATAATG<br>GGGCTATACTGTTCGTCAAAAATGGTCTCTACTACCTGGGAATCATGCCCAAACAGAAGGGCAGGTACA<br>AAGCCCTTTCGTTTGAGCCGACCGAAAAAACCAGCGAAGGCTTTGATAAGATGTATTACGACTATTTCCC<br>AGATGCAGCCAAGATGATCCCAAAATGTAGCACTCAGTTGAAGGCGGTAACCGCTCACTTTCAGACACA<br>CACCACTCCTATCTTGCTCTCCAACAACTTTATTGAGCCGCTGGAGATCACGAAGGAAATCTACGACCTT<br>AACAACCCAGAGAAGGAACCCAAGAAATTCCAAACAGCTTATGCTAAGAAGACTGGGGATCAAAAGGG<br>CTATCGAGAGGCTTTGTGTAAGTGGATTGACTTTACACGGGATTTCTGAGTAAGTATACCAAGACCACA<br>TCTATTGACCTGTCCTCACTGAGACCTTCCTCACAATATAAGGATCTCGGAGAGTATTATGCCGAACTCA<br>ACCCTCTACTCTATCACATCTCTTTCCAGAGGATCGCCGAAAAGGAAATTATGGACGCCGTCGAGACAG<br>GCAAGCTGTACCTCTTCCAGATTTACAACAAGGATTTCGCAAAGGGCCACCACGGAAAACCCAATTTGC<br>ACACTTTGTACTGGACAGGGCTCTTCTCTCCCGAAAATTTGGCCAAAACTTCAATAAAACTGAACGGGC<br>AAGCCGAGCTGTTCTATCGGCCCAAGTCACGTATGAAGCGGATGGCCCACCGGCTGGGCGAGAAGATGC<br>TCAACAAGAAACTGAAGGATCAGAAGACGCCCATACCAGACACTCTTTACCAAGAGCTGTATGACTACG<br>TGAATCACAGACTGAGTCACGACCTGTCTGATGAAGCCCGGGCTCTTCTTCCAAATGTGATTACCAAAG<br>AAGTTTCCCACGAAATTATCAAGGACCGGCGCTTCACCTCTGACAAATTCTTTTTCCACGTCCCAATCAC<br>CCTCAACTACCAGGCAGCCAATTCCCCTTCAAAGTTTAACCAGCAGTGTGAATGCCTACCTGAAAGAGCA<br>TCCGGAGACCCCCATCATAGGGATAGACAGAGGAGAGCGGAATCTTATCTACATTACTGTGATTGACAG<br>CACAGGTAAGATCTTGGAGCAGAGATCTTTAAATACAATCCAGCAGTTTGACTACCAGAAGAAACTGGA<br>TAACCGAGGAGAAGGAAAGGGTTGCTGCAAGACAGGCCTGGTCAGTGGTCGGCACCATCAAAGACCTGA<br>AGCAGGGCTACTTATCCCAAGTAATTCACGAAATTGTCGATCTTATGATTCATTATCAAGCCGTTGTTGT<br>GCTGGAGAACCTGAATTTTGGCTTCAAAAGCAAACGAACAGGTATCGCCGAGAAAGCCGTGTATCAGCA<br>GTTCGAAAAGATGCTCATAGACAAGCTGAACTGCTTAGTGCTGAAGGATTATCCTGCTGAGAAGGTCGG<br>CGGCGTACTTAACCCATACCAGCTGACCGATCAGTTCACTAGTTTCGCCAAGATGGGAACGCAAAGTGG<br>CTTCCTTTTCTACGTGCCCGCTCCCTACACGAGTAAGATCGACCTCTTTGACCGGCTTCGTCGACCCATTCG<br>TCTGGAAGACCATCAAGGAATCACGAATCACGGAAACACTTCTTAGAGGGGTTTGACTTCCTGCACTACG<br>ACGTGAAGACAGGGGACTTCATCTTACACTTTAAGATGAATCGAAACCTCTCCTTCCAGCGGGGCCTGC<br>CTGGTTTCATGCCCGCATGGGACATCGTGTTTGAGAAAAACGAGACACAGTTTGACGCTAAGGGAACCC<br>CCTTTATTGCGGGGAAGCGGATTGTCCCAGTCATCGAAAACCATCGTTTCACCGGGCATGACATCGGGATG<br>TGTACCCGGCCAACGAGCTCATCGCGCTGCTGGAGGAGAAGGGTATTGTGTTTAGGGATGGATCCAACA<br>TTCTGCCTAAGTTGCTGGAAAATGATGATTCGCACGCCATTGACACCATGGTTGCACTGATTAGATCCGT<br>ACTGCAGATGAGGAATAGCAATGCTGCAACCGGGGAGGATTATATTAATTCCCCAGTGCGAGATCTGAA<br>TGGTGTCTGTTTTGACTCGCGCTTTCAGAATCCAGAATGGCCAATGGATGCAGATGCCAATGGGGCGTA<br>CCACATTGCTCTGAAAGGCCAGCTACTCCTGAACACCTCAAGGAGAGCAAAGATCTGAAGCTGCAGAA<br>CGGCATTTCCAACCAAGACTGGCTCGCCTACATACAAGAACTGCGCAATTAA |
| SEQ ID NO: 159 | ATGGCTGTCAAATCCATCAAGGTTAAATTACGGCTTGATGACATGCCCGAGATCCGCGCCGGGCTCTGG<br>AAACTCCATAAAGAAGTGAATGCTGGCGTTAGATACTACACAGAATGGCTCTCCCTGCTGCGCCAGGAA<br>AATTTGTACCGCCGGTCACCTAATGGAGATGGAGAGCAGGAATGCGATAAAACAGCAGAAGAGTGCAA<br>AGCCGAATTGCTGGAGCGACTGCGGGCACGGCAGGTTGAGAATGGACACCGAGGTCCGGCGGGATCGG<br>ACGACGAGCTGCTCCAGCTCGCCAGACAATTATATGAACTGCTGGTGCCTCAGGCTATTGGGGCAAAGG<br>GTGACGCACAGCAGATTGCTAGAAAATTTCTGTCTCCCCTCGCCGACAAAGACGCTGTCGGCGGCCTTG |

TABLE 5-continued

| SEQ ID NO | Sequence |
|---|---|
| | GGATAGCCAAAGCCGGCAACAAACCCCGATGGGTGCGCATGAGGGAGGCTGGTGAGCCTGGCTGGGAG<br>GAAGAAAGGAAAGGCCGAAACCAGAAAGTCCGCCGACAGGACCGCGGACGTACTCCGAGCATTGGC<br>CGATTTTGGGCTGAAGCCCTTAATGCGAGTCTACACCGATAGTGAAATGTCTAGCGTGGAGTGGAAGCC<br>ATTACGCAAAGGGCAGGCAGTGCGGACGTGGGACCGTGACATGTTCCAGCAAGCCATCGAGCGAATGA<br>TGAGCTGGGAGAGCTGGAACCAGAGAGTGGGGCAGGAGTATGCCAAGCTGGTCGAGCAGAAAAACCGG<br>TTTGAGCAAAAAAATTTTGTAGGTCAGGAACACCTGGTGCATCTCGTTAACCAGCTCCAGCAAGATATG<br>AAGGAAGCTTCGCCTGGATTAGAGAGCAAAGAGCAGACTGCACACTATGTAACCGGAAGAGCACTGAG<br>GGGCAGTGACAAAGTGTTCGAAAAATGGGGAAAACTGGCTCCCGATGCCCCCTTTGACCTGTACGACGC<br>AGAAATAAAAAACGTGCAGCGGCGAAACACCAGGCGATTTGGTAGCCATGATCTGTTCGCCAAATTGGC<br>AGAGCCGGAATATCAGGCTCTTTGGCGAGAAGACGCATCATTTCTCACTAGGTACGCGGTCTATAACTC<br>CATTTTGAGGAAATTGAACCACGCAAAAATGTTTGCCACCTTCACGTTGCCTGACGCCACCGCTCATCCC<br>ATTTGGACACGGTTTGATAAGCTGGGCGGCAATCTGCATCAGTATACATTCCTGTTTAACGAGTTTGGAG<br>AGCGAAGACATGCGATACGATTCCACAAGCTACTGAAGGTGCAAAATGGCGTGGCACGTGAGGTGGAC<br>GATGTCACCGTGCCCATCAGCATGAGCGAACAGCTGGATAATTTGTTGCCGCGGGACCCAAATGAACCT<br>ATAGCCCTTTATTTTAGGGACTACGGGGCGGAGCAACATTTCACTGGGGAGTTTGGCGGCGCAAAAATT<br>CAGTGCCGACGCGACCAGCTCGCCCACATGCATAGAAGACGCGGGGCCCGGGACGTATACCTTAACGTC<br>TCTGTGAGGGTGCAGTCCCAGTCAGAGGCAAGAGGGGAACGCAGACCACCTTACGCAGCAGTATTCAG<br>GCTGGTAGGCGATAACCACCGGGCGTTTGTACACTTTGATAAACTTTCTGACTACCTGGCCGAACACCCG<br>GATGACGGCAAATTAGGATCGGAGGGGCTGCTTAGCGGCCTGCGTGTGATGAGCGTCGATCTGGGCTA<br>CGGACCTCTGCTTCCATCTCTGTGTTCCGTGTGGCCCGAAAGGACGAGTTGAAACCTAATTCGAAGGGCC<br>GTGTACCATTCTTTTTCCCTATTAAGGGAAATGATAATCTCGTCGCGGTGCACGAGCGTTCCCAACTGCT<br>GAAACTGCCTGGCGAGACCGAGTCCAAAGATCTCAGAGCAATCCGGGAGGAGCGACAACGTACACTTA<br>GGCAACTCCGCACCCAGCTGGCCTATCTGCGCTTGCTGGTGCGGTGCGGCTCCGAGGATGTAGGGAGAA<br>GAGAGCGAAGCTGGGCAAAGCTGATAGAGCAACCAGTTGACGCCGCGAATCACATGACCCCCGACTGG<br>CGCGAAGCGTTTGAAAATGAGCTGCAGAAGTTGAAATCTCTGCATGGGATTTGCTCAGATAAGGAGTGG<br>ATGGACGCCGTATACGAGTCTGTTCGCCGGGTATGGCGGCACATGGGGAAGCAGGTGAGAGATTGGAG<br>AAAGGACGTTCGCTCTGGGGAACGGCCGAAAATTCGGGGATACGCAAAGGATGTCGTGGGCGGCAATA<br>GCATTGAGCAGATCGAGTACCTGGAAAGGCAATACAAATTTCTGAAATCTTGGTCTTTCTTTGGGAAGGT<br>AAGCGGACAAGTTATCAGAGCGCAAAAGGGATCTCGCTTTGCTATCACATTGAGGGAACACATTGATCA<br>CGCCAAAGAAGACAGGTTGAAAAAGTTGGCTGATCGCATTATCATGGAAGCACTCGGTTACGTCTACGC<br>CCTTGATGAGCGCGGTAAAGGGAAGTGGGTAGCCAAGTATCCCCCATGTCAGCTGATCCTGCTCGAGGA<br>ACTTTCTGAGTATCAGTTCAATAACGACCGTCCTCCCTCCGAAAATAATCAGCTCATGCAATGGTCCCAC<br>CGGGGTGTGTTCCAAGAACTGATCAATCAGGCTCAGGTGCACGACCTCCTCGTAGGCACTATGTATGCA<br>GCCTTTAGCTCCCGTTTTGACGCGCGCACAGGCGCCCCTGGAATACGATGTAGGCGAGTTCCCGCACGGT<br>GCACTCAAGAACATAACCCGGAGCCTTTCCCATGGTGGCTCAATAAGTTTGTTGTGGAGCATACCCTCGA<br>CGCTTGCCCATTGAGGGCGGATGACTTGATTCCCACAGGCGAGGGGAGATCTTCGTGAGCCCATTTTCT<br>GCCGAAGAAGGGGATTTCCACCAAATACATGCCGACTTGAATGCTGCCCAAAATCTGCAGCAAAGGCTG<br>TGGTCAGACTTCGACATCTCGCAAATCAGACTGCGGTGTGACTGGGGCGAAGTAGACGGCGAGCTGGTG<br>CTGATACCTAGACTGACGGGTAAGCGTACCGCCGATAGCTATAGTAATAAGGTTTTTTATACGAATACG<br>GGGGTGACATATTACGAGCGTGAGAGAGGCAAGAAGCGTCGGAAGGTGTTCGCGCAGGAGAAGCTGAG<br>CGAAGAGGAGGCGGAGCTACTGGTAGAGGCAGATGAGGCAAGAGAAAAGTCCGTCGTCCTGATGCGGG<br>ATCCTAGCGGGATTATTAACAGAGGTAATTGGACACGGCAGAAAGAATTCTGGAGCATGGTGAATCAAA<br>GAATCGAGGGTTACCTGGTGAAGCAAATTCGAAGCCGGGTGCCCCTTCAAGACAGCGCATGTGAAAACA<br>CTGGGGACATCTAG |
| SEQ ID NO: 160 | ATGGCTACTCGGTCCTTCATCCTGAAAATCGAGCCAAATGAAGAGGTGAAAAAGGGCCTGTGGAAGACC<br>CATGAGGTACTTAACCACGGCATAGCATACTATATGAATATCCTAAAACTTATACGGCAGGAGGCTATC<br>TACGAGCATCACGAGCAAGATCCTAAAAATCCAAAGAAGGTTAGTAAGGCTGAAATCCAGGCTGAATT<br>GTGGGACTTCGTGCTGAAGATGCAGAAATGCAACAGTTTCACGCATGAAGTTGATAAGGACGTCGTGTT<br>TAATATACTCCGGGAGCTGTACGAAGAACTGGTACCAAGCTCTGTGGAAAAGAAAGGAGAGGCCAACC<br>AGCTAAGTAATAAGTTCCTCTATCCTCTCGTGGACCCCAATTCACAGAGCGGCAAAGGTACCGCATCTTC<br>TGGGAGGAAACCACGCTGGTACAACTTGAAGATCGCTGGCGATCCCAGCTGGGAGGAGGAAAGAAGA<br>AATGGGAAGAGGATAAAAAGAAAGACCCCCTGGCCAAAATCTTAGGCAAGCTCGCCGAGTACGGTCTG<br>ATTCCACTTTTCATCCCGTTCACAGATAGCAATGAGCCGATCGTCAAGGAGATTAAGTGGATGGAAAAG<br>AGCCGCAATCAGAGTGTGCGGAGGCTGGACAAAGACATGTTTATTCAGGCCCTGGAACGCTTCCTTAGC<br>TGGGAAAGCTGGAACCTGAAGGTTAAGGAAGAGTACGAAAAGTCGAGAAGGAGCATAAGACTTTGGA<br>GGAGCGCATCAAAGAAGACATCCAGGCCTTTAAGTCTCTAGAACAGTATGAGAAAGAACGGCAGGAAC<br>AGCTGCTGCGTGATACACTGAACACAAACGAATATCGCCTGAGCAAGAGGGGACTCAGAGGCTGGAGA<br>GAAATCATTCAAAAGTGGCTCAAAATGGATGAAAATGAGCCGTCTGAAAAATACCTTGAAGTTTTCAAG<br>GACTACCAGCGGAAGCACCCTAGAGAAGCCGGCGACTATAGTGTTTACGAATTCTTGAGCAAGAAGGA<br>GAATCATTTTATATGGAGGAATCACCCGGAGTACCCATATCTGTACGCAACCTTCTGCGAAATCGACAA<br>GAAAAAAAAGACGCCAAGCAACAGGCTACATTTACTCTGGCCGACCCTATCAATCACCCTCTATGGGT<br>CCGGTTTGAGGAGCGCTCCGGAAGCAATCTGAATAAATATCTGACTGAACAGTTACACACAGA<br>GAAGCTCAAGAAGAAACTTACGGTGCAGCTGGACCGCCTGATATACCCAACAGAGTCCGGAGGATGGG<br>AAGAGAAAGGAAAGGTTGACATCGTACTGCTTCCATCTCGTCAGTTTTACAACCAGATATTCCTGGACAT<br>CGAGGAGAAGGGGAAACACGCCTTCACATACAAGGACGAGTCCATAAAGTTCCCACTGAAGGGTACTTT<br>AGGCGGTGCTAGGGTGCAGTTCGACCGCGATCACCTGAGACGGTACCCCCACAAGGTGGGAGCGGGA<br>ACGTGGGACGAATCTACTTTAATATGACAGTGAACATTGAACCCACAGAGAGTCCAGTTAGTAAATCCC<br>TGAAAATTCACCGTGACGACTTTCCGAAATTTGTGAATTTCAAGCCAAAGGAGCTTACGGAGTGGATCA<br>AGGATTCAAAGGGAAAGAAGCTGAAATCTGGTATCGAATCTCTCGAGATCGGTCTCCGTGTCATGAGCA<br>TCGATCTGGGACAGCGCCAGGCAGCTGCCGCCAGTATATTCGAAGATCTTCAGAATCGCAAAAGCCTGACATCG<br>AGGGAAAGCTCTTCTTCCCAATCAAAGGCACAGAGCTGTATGCGGTGCACCGGGCGTCCTTTAATATAA<br>AGCTGCCCGGTGAAACCCTGGTGAAGTCACGGGAGGTGCTTAGAAAAGCGCGAGAGGATAACCTCAAA<br>CTGATGAACCAAAAACTGAACTTTCTGAGGAACGTCCTGCACTTTCAGCAGTTCGAAGATATTACCGAA<br>CGCGAAAAGAGAGTAACCAAGTGGATATCTCGTCAAGAGAACAGCGACGTCCCGTTAGTCTATCAGGAC<br>GAACTCATCCAAATACGGGAGTTGATGTATAAGCCCTACAAGGATTGGGTCGCCTTTCTTAAGCAGCTTC |

TABLE 5-continued

| SEQ ID NO | Sequence |
|---|---|
| | ACAAACGCCTAGAGGTCGAAATAGGTAAAGAGGTGAAACATTGGCGGAAGTCGCTCAGCGACGGGAGG<br>AAGGGACTTTATGGCATCTCTTTGAAGAACATTGACGAAATCGATAGAACCAGAAAATTTTTGTTGAGA<br>TGGTCCCTCCGACCCACCGAGCCTGGAGAGGTGAGGCGGTTAGAACCAGGACAGAGGTTCGCTATCGAT<br>CAGCTGAATCACCTCAATGCTCTGAAGGAGGACCGCCTCAAGAAAATGGCCAATACAATCATAATGCAC<br>GCCCTTGGCTACTGCTACGACGTCCGAAAGAAGAAGTGGCAGGCCAAGAATCCCGCCTGTCAAATTATC<br>CTTTTTGAGGATCTTAGCAATTACAACCCCTATGAAGAGCGGTCCAGATTCGAAAATAGTAAGCTCATG<br>AAGTGGAGCCGCAGGGAGATCCCGCGCCAAGTGGCCCTTCAGGGGGAAATTTATGGGCTGCAGGTAGG<br>CGAGGTCGGGGCCCAATTCTCCTCGCGCTTTCATGCGAAAACTGGAAGTCCTGGAATCCGGTGCTCAGT<br>GGTGACAAAGGAGAAGTTGCAAGACAATCGGTTTTTTAAAAACTTACAGCGGGAGGGAAGGCTGACCC<br>TGGATAAGATAGCCGTACTTAAGGAAGGAGATCTGTACCCTGACAAAGGCGGTGAAAAGTTCATTAGCT<br>TGAGCAAGGACCGAAAACTTGTGACCACCCACGCTGACATCAATGCGGCACAGAACCTGCAGAAGAGA<br>TTTTGGACTCGCACCCACGGATTCTACAAAGTTTACTGCAAAGCATATCAAGTAGACGGACAGACCGTA<br>TACATCCCCGAGTCCAAAGATCAGAAGCAGAAAATTATTGAAGAGTTTGGGGAAGGGTACTTTATCCTG<br>AAGGATGGTGTCTACGAATGGGGCAACGCTGGTAAACTTAAAATTAAGAAGGGCAGCTCTAAACAGTCC<br>TCCAGCGAGTTAGTTGATTCTGATATTCTGAAAGACAGTTTCGACCTGGCCAGCGAACTTAAAGGGGAA<br>AAATTAATGCTGTACCGGGACCCCAGCGGAAACGTCTTTCCATCCGATAAGTGGATGGCCGCTGGAGTG<br>TTCTTTGGCAAGTTAGAGAGGATTCTCATAAGTAAGCTGACCAACCAATACTCAATCTCCACAATCGAG<br>GATGACTCATCCAAGCAGTCTATGTGA |
| SEQ ID NO: 161 | ATGCCTACACGCACTATCAACCTGAAACTGGTTCTTGGCAAGAATCCAGAGAATGCTACCCTTCGTCGG<br>GCACTATTTTCAACGCATAGACTGGTGAATCAGGCTACCAAACGGATTGAAGAGTTCCTCTTGCTTTGTC<br>GGGGGGAAGCATATAGGACGGTGGATAATGAGGGGAAAGAGGCTGAAATTCCGAGACACGCCGTGCAG<br>GAGGAAGCTCTTGCGTTTGCAAAGGCCGCTCAACGGACAATGGTTGCATCTCTACTTATGAAGACCAG<br>GAAATCCTGGATGTGCTCCGGCAACTGTATGAAAGGCTGGTGCCTTCTGTGAATGAAAATAATGAAGCA<br>GGGGACGCTCAAGCCGCAAACGCGTGGGTGTCGCCACTGATGTCGCCGAGGGAGGGCTCAG<br>CGTTTACGACAAGGTGCTGGACCCACCCCCAGTGTGGATGAAACTCAAAGAGGAAAAAGCTCCGGGCTG<br>GGAGGCTGCTTCCCAGATCTGGATCCAGTCCGACGAAGGGCAGTCCCTTCTTAACAAGCCTGGTTCGCCC<br>CCGCGGTGGATTAGGAAACTGAGGTCAGGCCAGCCTTGGCAGGACGATTTTGTTAGCGACCAGAAAAG<br>AAGCAGGACGAGCTGACAAAGGGGAATGCGCCACTGATCAAACAATTAAAGGAAATGGGCTTATTGCC<br>TCTTGTGAATCCCTTTTTTAGACATCTGCTTGACCCGGAGGGGAAGGGGTGTCACCTTGGGACAGACTC<br>GCTGTTAGGGCCGCTGTCGCTCATTTCATATCATGGGAATCATGGAACCACCGGACACGCGCCGAATAC<br>AATAGTTTGAAGCTGCGGAGGGATGAGTTCGAAGCAGCTTCCGACGAATTCAAGGACGACTTCACGCTG<br>CTTCGGCAGTACGAGGCTAAGAGGCACTCCACACTGAAGAGTATAGCTTTAGCCGATGATTCAAACCCT<br>TATAGGATCGGCGTACGCTCCCTCCGCGCTTGGAACGCGTCGCGAGGAGTGGATCGACAAGGGAGCG<br>ACCGAGGAGCAGCGGGTCACCATTCTCAGCAAGTTGCAGACCCAACTAAGGGGCAAATTTGGAGATCCT<br>GACTTGTTCAACTGGCTGGCGCAGGACCGGCACGTGCACCTCTGGAGCCCTAGAGATAGTGTTACCCCA<br>CTGGTTAGGATCAACGCTGTTGACAAAGTATTGCGACGGAGAAAACCGTACGCCTTGATGACTTTTGCC<br>CACCCAAGATTCCACCCTCGGTGGATACTTTTACGAAGCCCCAGGGGGCAGCAATCTCCGCCAGTATGCA<br>CTGGATTGTACCGAAAATGCTCTGCACATTACACTGCCTCTGCTGGTTGACGATGCACATGGCACATGGA<br>TTGAGAAAAAATTAGGGTTCCTCTTGCCCCAGCGGCCAGATTCAGGACCTGACACTAGAAAAGCTCG<br>AGAAGAAGAAAATCGTCTCTACTACCGTTCTGGGTTCCAGCAGTTTGCCGGCCTGGCCGGAGGTGCCG<br>AGGTGCTTTTCCATCGACCATACATGGAGCACGATGAGAGGAGCGAGGAGCTTATTAGAACGCCCTG<br>GTGCTGTTTGGTTCAAACTCACCTTGGACGTGGCAACCCAGGCCCCTCCAAACTGGTTGGACGGAAAGG<br>GCCGCGTCCGAACGCCCCCGAGGTTCACCACTTCAAGACAGCCCTCAGTAACAAGTCTAAGCACACAC<br>GGACCCTCCAGCCCGGACTCAGAGTGTTATCCGTGGATCTGGGAATGCGCACCTTCGCCTCTTGCTCCGT<br>ATTTGAGCTGATCGAGGGCAAACCAGAGACTGGCAGAGCGTTTCCTGTGGCCGACGAACGTTCCATGGA<br>TTCACCAAACAAGCTGTGGGCCAAGCACGAAAGATCCTTTAAACTCACGCTCCCCGGCGAAACCCCCAG<br>TCGGAAAGAAGAGGAGGAACGGAGCATTGCAAGAGCCGAAATCTATGCGTTGAAAAGAGATATTCAGA<br>GATTAAAAAGTCTTCTGCGCCTGGGGGAAGAGGATAACGATAATAGACGCGATGCACTTCTTGAGCAAT<br>TTTTCAAGGGCTGGGGCGAGGAAGACGTGGTTCCAGGTCAGGCCTTTCCCCGGAGTCTGTTCCAGGGGC<br>TGGGGGCCGCCCCATTCAGATCCACCCCTGAGTTGTGGAGACAACACTGTCAAACCTATTATGATAAAG<br>CAGAGGCGTGCCTGCTAAACACATCAGCGATTGGCGCAAGAGAACCAGGCCTAGGCCTACCTCACGTG<br>AGATGTGGTACAAGACACGCTCTTATACGCGGAAAGTCAATCTGGATGCTGGAATACCTCGACGCTG<br>TGAGGAAACTGCTCTTATCCTGGAGCCTCAGAGGCCGGACCTACGGGGCTATCAACAGACAGGACACAG<br>CAAGGTTCGGGAGCTTAGCCAGCCGGCTCCTTCACCACATTAACTCACTCAAAGAGGATCGAATAAAGA<br>CCGGAGCCGACTCGATCGTGCAGGCAGCCCGAGGGTACATCCCCCTGCCTCATGGGAAGGGCTGGGAGC<br>AGCGATATGAACCCTGCCAGCTGATCTTGTTTGAGGACCTTGCCCGTTATAGATTTCGCGTTGATAGACC<br>TCGCCGTGAGAATTCTCAGCTGATGCAGTGGAACCACAGAGCGATCGTGGCTGAGACCACTATGCAGGC<br>CGAGCTGTATGGACAGATCGTGGAGAACACCGCCGCAGGGTTCAGTTCTCGGTTTCATGCTGCCACCGG<br>AGCTCCCGGCGTCCGGTGCCGCTTCCTCTTAGAGCGTGATTTTGACAATGACCTCCCAAAGCCCTATCTG<br>CTGAGGGAACTGAGCTGGATGCTGGGGAACACAAAAGTAGAATCGGAGGAGGAGAAGCTACGGCTCCT<br>CTCCGAAAAGATACGTCCAGGCTCTCTGGTACCATGGGACGGAGGAGAGCAGTTCGCGACACTGCATCC<br>TAAGAGACGTTATGTGATTCACGCCGATATGAACGCCGCTCAGAATCTGCAGAATGCTGCCACCGG<br>TGGCCGCTGCGGCGAAGCCTTCAGGCTGGTATGTCAGCCCCACGGGGATGATGTGCGCGGCTGGCCTC<br>AACCCCTGGGGCTAGACTCTTGGGGGCACTCCAGCAGCTGGAAAATGGCCAAGGGGCTTTCGAACTCGT<br>TCGGGACATGGGCAGCACAAGCCAGATGAACAGATTCGTCATGAAGAGCCTGGGAAAGAAAAAGATCA<br>AACCCTTACAGGACAATAATGGCGACGACGAACTGGAGGACGTGTTGTCCGTGCTGCCAGGAAGAC<br>GACACAGGCCGCATCACTGTCTTCCGCGACTCAAGTGGGATATTCTTTCCTTGCAACGTGTGGATTCCGG<br>CCAAACAGTTCTGGCCTGCCGTCAGAGCCATGATTTGGAAAGTGATGGCTAGTCATTCATTGGGATGA |
| SEQ ID NO: 162 | ATGACAAAGCTGAGGCACAGACAAAAGAAGCTTACACACGACTGGGCAGGGAGCAAGAAACGTGAGGT<br>CCTTGGGTCAAATGGAAAACTGCAGAACCCCTTGCTCATGCCTGTAAAGAAGGGGCAGGTAACAGAATT<br>TAGAAAAGCATTCTCCGCGTACGCTCGGGCAACTAAGGGGGAAATGACCGATGGACGGAAGAACATGT<br>TCACCCATTCTTTCGAGCCATTCAAAACAAAGCCGTCATTGCACCAATGCGAGCTGGCCGATAAGGCTTA<br>CCAGTCTTTGCATAGTTACCTCCCCGGTTCCCTGGCCCATTTCTTGCTTTCCGCACACGCACTGGGCTTTC<br>GTATTTTCTCTAAATCTGGGGAGGCAACTGCCTTCCAGGCCAGCTCAAAAATCGAGGCCTATGAGTCCA |

| SEQ ID NO | Sequence |
|---|---|
| | AGCTCGCTTCGGAGCTAGCCTGTGTCGATTTGAGTATCCAGAATTTGACGATTAGTACTCTTTTCAACGC<br>TCTCACAACTTCAGTTCGGGGCAAGGGGGAGGAAACTTCAGCAGATCCCCTTATCGCACGGTTCTACAC<br>TCTCCTGACGGGCAAGCCCCTGAGCCGAGACACACAGGGCCCAGAACGGGACTTGGCAGAGGTCATCTC<br>CAGAAAGATCGCCTCGTCCTTCGGCACATGGAAGGAAATGACTGCCAATCCCTCTGCAGAGCCTCCAGTT<br>CTTCGAAGAAGAGCTTCATGCACTAGATGCCAACGTGTCTTTATCTCCAGCTTTTGATGTGTTAATCAAG<br>ATGAATGATCTCCAAGGTGATCTGAAGAACCGTACTATAGTGTTCGACCCAGATGCACCCGTGTTCGAG<br>TACAACGCTGAGGATCCAGCCGATATCATCATAAAGCTGACAGCTCGGTATGCGAAGGAGGCCGTCATC<br>AAGAATCAGAACGTGGGCAATTATGTGAAAAACGCCATTACCACCACTAATGCCAATGGGCTGGGGTGG<br>CTCCTCAATAAAGGGCTTTCACTACTGCCAGTTTCTACTGACGATGAGCTGCTCGAATTCATTGGGGTGG<br>AGAGAAGCCATCCCAGCTGTCACGCGCTGATAGAGCTGATTGCCAGCTAGAGGCGCCGGAACTGTTTG<br>AGAAGAATGTGTTTAGTGACACCCGTTCCGAGGTTCAGGGTATGATCGACAGTGCAGTGTCGAACCACA<br>TTGCTCGGCTGTCCAGCAGCCGAAACTCCCTGAGCATGGACAGCGAGGAATTGGAACGCTTGATTAAAT<br>CTTTCCAGATTCATACTCCCCATTGTTCTCTGTTCATAGGCGCTCAGTCCTTATCTCAGCAGCTGGAGAGC<br>TTACCTGAGGCGCTGCAGTCCGGAGTGAACAGCGCTGATATCTTATTAGGCAGCACACAGTATATGCTG<br>ACCAACTCTCTCGTTGAAGAGTCAATTGCAACATATCAAAGGACATTAAATAGGATCAATTACCTGAGT<br>GGGGTGGCTGGGCAGATTAACGGTGCTATCAAAAGAAAGGCAATCGACGGCGAAAAAATACACCTGCC<br>TGCCGCCTGGAGTGAGCTCATCTCCTTACCTTTCATTGGACAGCCGGTGATTGATGTGGAGAGCGACCTG<br>GCACACTTAAAAAACCAGTACCAGACCCTGTCCAATGAATTTGACACCCTCATTTCGGCCCTGCAGAAG<br>AACTTCGATTTGAATTTCAACAAAGCACTCCTTAACCGCACGCAGCATTTCGAGGCAATGTGCCGGAGC<br>ACAAAAAAAATGCTTTATCTAAGCCCGAGATCGTGTCCTACAGAGATCTGCTGGCGCGGCTGACCAGT<br>TGCCTTTATCGAGGCTCGCTGGTTCTCAGAAGGGCGGGAATTGTTCTGAAAAAGCACAAAATCTTT<br>GAGTCGAATAGTGAGCTGAGAGAACACGTCCACGAGCGAAAGCACTTCGTGTTCGTTAGTCCATTGGAC<br>AGAAAGGCAAAAAACTGTTGCGCCTGACCGATTCCCGCCCTGACTTGCTCCATGTGATCGATGAGATC<br>CTGCAACATGACAATCTGGAGAATAAGGACAGAGAGTCCCTTTGGCTGGTCCGGTCTGGGTACCTCCTT<br>GCTGGTCTGCCGGACCAGCTGAGTTCTTCGTTTATCAATCTCCCCATAATCACGCAAAAGGGCGATCGCC<br>GGCTGATTGACCTGATTCAGTATGACCAGATCAATCGCGATGCTTTCGTAATGTTGGTGACAAGTGCTTT<br>CAAAAGCAATCTCTCTGGGTTGCAGTACCGCGCTAACAAGCAGTCTTTCGTGGTCACCCGCACCCTGTCT<br>CCTTACCTGGGTAGTAAGCTCGTATACGTCCCTAAAGACAAAGATTGGCTGGTCCCATCCCAGATGTTTG<br>AGGGAAGATTCGCCGATATTCTGCAGAGTGACTACATGGTCTGGAAGTCGGACGCCTGTGCGTGA<br>TCGACACTGCCAAACATCTCTCTAACATTAAAAAAAGCGTGTTTAGTAGCGAAGAAGTCCTTGCTTTTCT<br>TCGAGAGCTGCCTCACCGGACCTTCATCCAGACCGAGGTACGGGGGTTAGGAGTGAACGTCGATGGAAT<br>CGCATTTAATAACGGGGATATCCCGAGCTTGAAGACATTCTCGAATTGTGTGCAGGTGAAGGTGAGTAG<br>GACTAATACTAGTCTCGTGCAGACTCTAAACAGGTGGTTCGAGGGTGGCAAAGTGTCACCTCCCTCTATT<br>CAGTTCGAAAGAGCTTACTACAAAAAAGACGATCAGATTCACGAGGACGCGACCAAGAGAAAGATACG<br>CTTCCAGATGCCAGCAACGGAATTAGTGCACGCCAGCGATGACGCTGGTTGGACCCCCAGCTACCTGCT<br>GGGCATCGACCCCGGTGAGTACGAATGGGTCTCAGTTTGGTGTCCATCAACAATGGAGAGGTCCTGGA<br>TTCTGGATTCATCCACATTAATTCCCTGATCAATTTCGCGTCCAAAAAAAGCAATCACCAGACCAAAGTA<br>GTCCCCGCCAGCAGTACAAGTCCCCCTACGCGAATTATCTCAGCAGTCAAAGGATTCAGCAGCAGGG<br>GATATAGCTCACATTCTGGATCGGCTAATCTACAAATTGAACGCCTTGCCTGTGTTCGAGGCGCTGTCTG<br>GCAACAGTCAGAGTGCTGCTGATCAGGTATGGACCAAAGTTCTATCCTTCTATACATGGGGAGACAACG<br>ACGCACAGAACAGTATACGGAAGCAGCACTGGTTCGGTGCCTCACACTGGGATATTAAGGGGATGCTGC<br>GCCAACCCCAACCGAAAAAAAACCCAAACCATATATAGCCTTTCCGGGATCAAGTGTCATCCTATG<br>GAAATAGTCAAAGGTGTAGTTGTTGCGGCCGCAATCCCATTGAGCAGTTGCGTGAGATGGCAAAGGACA<br>CGAGTATCAAGGAGCTGAAAATCCGAAATAGTGAGATCCAACTATTCGATGGTACAATCAAGCTGTTTA<br>ACCCCGACCCTTCCACCGTCATCGAGAGGCGGCGGCATAACCTAGGACCCTCACGCATTCCTGTGGCAG<br>ACCGAACTTTCAAGAATATTAGCCCTTCTTCGTTAGAGTTCAAGGAGCTCATTACTATCGTTTCTCGAAG<br>CATCCGCCATAGCCCCGAATTTATTGCTAAGAAACGGGGTATCGGGTCTGAGTACTTTTGTGCTTATTCT<br>GACTGCAACTCCTCACTGAACTCAGAGGCCAATGCCGCGGCCAATGTGGCACAGAAGTTTCAGAAGCAA<br>CTCTTTTTCGAACTCTGA |
| SEQ ID NO: 163 | ATGAAACGTATTCTGAACTCTCTGAAAGTCGCCGCACTGAGGCTGCTGTTTCGAGGAAAGGGCTCAGAG<br>CTGGTGAAGACCGTCAAGTACCCTCTGGTTTCGCCCGTCCAGGGTGCTGTGGAAGAACTCGCCGAAGCA<br>ATACGCCACGACAACCTACATTTATTTGGGCAGAAGGAAATCGTAGATCTGATGGAGAAGGACGAGGG<br>CACCCAGGTCTACTCGGTGGTGGACTTTTGGCTCGACACACTCCGTCTAGGGATGTTCTTCAGTCCAAGT<br>GCTAATGCCCTTAAGATCACTCTGGGGAAGTTTAACAGCGACCAAGTTTCCCCTTTCAGGAAGGTTCTGG<br>AGCAGTCCCCTTTCTTTCTCGCGGGTAGACTCAAAGTGGAGCCCGCTGAACGTATCCTCAGCGTGGAGAT<br>CCGCAAGATCGGTAAGAGGGAGAATAGAGTGGAGAACTACGCCGCAGATGTAGAGACTTGTTTTATCG<br>GTCAGCTGTCTAGTGATGAAAAGCAGTCTATCCAGAAGCTCGCTAACGATATCTGGGACTCTAAGGATC<br>ACGAAGAGCAAAGGATGCTTAAGGCGGATTTCTTTGCCATTCCCCTCATCAAAGACCCAAAGGCAGTGA<br>CCGAGGAAGATCCCGAGAATGAAACCGCAGGCAAACAGAAGCCTCTCGAATTATGTGTGCTTAGTGC<br>CCGAGTTGTACACCCGCGGGTTCGGTTCAATAGCGGACTTCCTGGTCCAGCGTCTGACACTATTAAGAGA<br>CAAAATGAGCACAGACACAGCAGAAGACTGCCTTGAGTATGTCGGCATAGAGGAGGAGAAGGGTAATG<br>GGATGAACTCGCTGCTGGGGACGTTCCTCAAGAACCTGCAGGGACAGGGGTTCGAACAGATCTTCCAAT<br>TTATGCTCGGCAGTTACGTGGGATGGCAAGGTAAGGAAGACGTCCTACGCGAACGGCTTGATTTGCTAG<br>CGGAGAAGGTTAAAGACTGCCGAAACCTAAGTTTGCCGGCGAGTGGTCCGGCCATCGGATGTTCCTGC<br>ATGGTCAATTGAAGAGCTGGTCCTCTAACTTTTTCCGCCTGTTTAACGAGACTAGGGAGCTCCTCGAAAG<br>CATAAAATCCGACATCCAACCAGCGACCATGTTAATCAGCTAACGTCGAAGAGAAAGGGGGATACCACCC<br>ACAACTCTTGTCACAGTACAGGAAACTAATGGAGCAGCTGCCAGCTCTCAGAACAAAGGTGTTAGATCC<br>AGAGATAGAAATGACTCACATGAGCGAGGCGGTAAGGTCGTACATTATGATCCACAAGTCGGTAGCAG<br>GATTTCTGCCTGACTTACTCGAGTCCCTCGATAGGGACAAGGACAGGGAATTCCTGCTGAGTATATTTCC<br>AAGGATCCCCAAATTGACAAAAAAACTAAGGAAATCGTGGCCTGGGAGCTCCAGGCGCCGGAAG<br>AAGGATACCTGTTCACTGCCAATAATCTTTTTCGCAACTTTCTGGAGAATCCTAAACATGTTCCACGTTTC<br>ATGGCAGAAAGGATCCCGGAAGATTGGACGCGCCTGCGGTCCGCTCCCGTATGGTTTGACGGCATGGTG<br>AAACAATGGCAGAAAGTGGTAAACCAGCTGGTGGAGTCACCTGGAGCATTGTATCAGTTCAATGAAAGC<br>TTTCTCCGACAACGTTTACAGGCAATGCTGACAGTGTATAAGAGAGACCTGCAGACAGAGAAATTCCTT<br>AAGTTGTTGGCTGATGTCTGCAGGCCTCTGGTGGACTTCTTTGGGCTGGGGGGAAACGATATCATCTTCA |

TABLE 5-continued

| SEQ ID NO | Sequence |
|---|---|
| | AAAGCTGCCAGGACCCGAGGAAACAATGGCAAACTGTCATTCCCTTGAGTGTCCCCGCTGATGTGTACA<br>CCGCGTGTGAGGGGCTGGCAATCCGGCTTCGTGAGACATTGGGATTTGAGTGGAAGAACCTTAAGGGCC<br>ATGAAAGGGAGGACTTTCTAAGACTGCACCAGCTTTTAGGGAATCTGCTTTTCTGGATTCGAGATGCCAA<br>ACTGGTGGTGAAATTGGAAGATTGGATGAATAATCCCTGTGTTCAGGAGTACGTTGAGGCTCGTAAGGC<br>CATTGATCTCCCACTGGAGATCTTCGGCTTTGAGGTCCCCATCTTCCTGAACGGATATCTGTTTAGTGAA<br>CTGAGGCAGTTAGAACTGCTGCTCCGCCGTAAGTCGGTTATGACCAGCTATTCGGTTAAGACAACTGGC<br>AGTCCAAACAGGCTTTTCCAGTTAGTCTACCTGCCATTAAATCCTTCCGACCCTGAGAAAAAAAATTCTA<br>ATAACTTTCAGGAACGCCTGGACACCCCCACTGGCTTATCACGTCGCTTCCTGGACCTTACTCTGGACGC<br>CTTCGCCGGCAAGTTGCTGACAGACCCCGTGACTCAAGAGCTTAAAACTATGGCTGGGTTCTACGATCA<br>CCTGTTTGGTTTCAAGCTCCCATGTAAGCTGGCAGCCATGTCTAACCACCCTGGCTCTAGCAGCAAGATG<br>GTCGTGTTGGCCAAACCTAAAAAAGGGGTTGCATCTAATATAGGATTGAACCAATCCCTGATCCCGCG<br>CACCCCGTATTCCGGGTGAGATCATCATGGCCAGAGCTGAAGTATCTGGAGGGGTTACTGTATCTTCCAG<br>AAGACACTCCACTGACAATAGAGCTCGCAGAGACAAGTGTTAGTTGTCAGAGCGTCAGTAGCGTGGCAT<br>TCGATCTGAAAAATCTGACTACTATCCTTGGACGCGTGGGTGAGTTCCGTGTGACCGCAGACCAGCCTTT<br>TAAGTTGACCCCCATCATCCCTGAGAAGGAGGAGTCCTTCATAGGAAAAACATATCTAGGCCTTGATGC<br>CGGGGAACGCTCAGGCGTAGGGTTCGCTATCGTCACAGTCGACGGGGATGGGTACGAGGTACAGCGCCT<br>GGGGGTGCATGAAGATACACAGCTGATGGCCCTACAGCAGGTGGCTCTAAAAGCTTGAAGGAGCCGG<br>TGTTCCAGCCGCTCAGAAAGGGTACTTTTCGGCAGCAGGAACGTATTAGAAAATCTCTCAGAGGATGTT<br>ATTGGAACTTCTATCACGCTCTGATGATTAAGTACCGCGCCAAGGTAGTGCACGAAGAGAGCGTGGGCA<br>GTTCCGGCCTGGTTGGGCAGTGGTTACGAGCATTCCAGAAGGACCTCAAGAAAGCCGATGTGTTGCCAA<br>AAAAGGGAGGCAAAAACGGAGTCGATAAGAAAAAGAGAGATCTTCTGCACAAGACACATTGTGGGGA<br>GGGGCTTTTAGCAAGAAGGAAGAACAGCAGATAGCTTTCGAAGTCCAAGCTGCTGGTTCTAGCCAGTTC<br>TGCCTGAAGTGCGGATGGTGGTTCCAACTCGGAATGCGTGAGGTTAATCGCGTGCAGGAATCCGGCGTC<br>GTGCTGGATTGGAATCGGAGTATTGTCACATTCCTGATTGAGAGCTCTGGCGAGAAAGTGTATGGGTTCT<br>CCCCTCAGCAACTCGAAAAGGGGTTCAGACCAGACATTGAAACCTTCAAGAAGATGGTTCGGGATTTCA<br>TGCGCCCGCCTATGTTTGACCGGAAGGGTCGCCCAGCAGCTGCCTACGAAAGGTTTGTCTTGGGACGCC<br>GGCATCGGCGGTATAGATTCGACAAGGTTTTTGAAGAACGATTCGGACGATCCGCGCTATTCATTTGCCC<br>GAGGGGTTGGCTGTGGCAACTTTGACCACAGCAGCGAGCAGTCAGCCGTAGTGCTGGCTCTAATCGGATA<br>TATTGCCGACAAAGAGGGGATGAGCGGAAAAAAGCTAGTCTACGTGCGTCTGGCAGAACTAATGGCGG<br>AATGGAAATTGAAGAAACTGGAGAGGAGTAGAGTTGAGGAGCAAAGCTCCGCTCAGTGA |
| SEQ ID NO: 164 | ATGGCGGAGTCGAAGCAAATGCAGTGCAGGAAGTGTGGAGCCTCTATGAAGTACGAAGTGATCGGCCT<br>CGGGAAGAAAAGCTGCAGATATATGTGTCCCGACTGGGGAATCACACATCTGCAAGAAAGATTCAGA<br>ATAAGAAGAAAAGGGACAAGAAGTATGGATCTGCCAGTAAAGCACAAAGCCAACGAATCGCAGTTGCA<br>GGGGCCTTATACCCGGATAAAAAGGTTCAGACCATCAAGACTTATAAGTATCCAGCCGACCTGAATGGT<br>GAGGTCCATGACTCAGGGGTGGCCGAAAAAATAGCCCAAGCAATCCAGGAGGATGAAATAGGGCTCCT<br>CGGCCCCTCTTCCGAGTACGCTGTTGGATCGCTAGCCAGAAACAGAGCGAGCCCTACAGTGTTGTAGA<br>CTTTTGGTTTGACGCTGTGTGCGCCGGAGGCGTGTTCGCCTATTCTGGGGCTAGATTGCTGCTCAGTCC<br>TGCAGCTATCTGGGGAGGAGAGCGTCCTACGCGCAGCCCTGGCATCCTCCCCTTTTGTCGACGATATCA<br>TCTGGCACAGGCCGAAAAATTTCTGGCGGTGTCCAGGCGAACCGGCCAAGATAAGCTGGGGAAGCGCA<br>TTGGAGAGTGCTTCGCAGAGGGCCGACTTGAGGCCCTAGGCATCAAGGACCGGATGCGTGAATTTGTCC<br>AGGCTATCGATGTCGCTCAGACCGCTGGGCAGCGTTTTGCCGCGAACTGAAATCTTTGGGATTTCTCA<br>GATGCCCGAGGCAAAGCAGTGGAACAATGACAGCGGACTCACCGTGTGCATCCTGCCCGACTATTACGT<br>CCCAGAAGAAAATCGCGCAGATCAGTTGGTCGTCCTGCTAAGACGACTGAGAGAGATAGCATACTGTAT<br>GGGGATCGAAGATGAGGCCGGTTTTGAACATCTTGGAATTGATCCTGGCGCACTATCAAATTTTTCCAAT<br>GGCAATCCTAAACGCGGATTTTTGGGCCGCTGCTGAACAATGATATTATTGCCTTAGCGAACAACATGT<br>CCGCCATGACGCCTTACTGGGAGGGCAGGAAGGGGAGAACTGATTGAAAGATTGGCTTGGCTGAAGCAC<br>CGTGCAGAGGGGCTTTATCTGAAGGAACCGCATTTTGGAAATAGTTGGGCCGACCATAGGTCTAGAATT<br>TTTTCCAGAATAGCCGGGTGGCTTTCTGGGTGCGCTGGGAAGCTAAAGATCGCCAAAGACCAGATCAGC<br>GGAGTGCGTACTGATCTGTTCCTTCTGAAGAGACTGCTCGGATGCGGTCCCGCAGTCCGCCCCTTCTCCCG<br>ACTTCATAGCCTCTATCTCTGCCTTGGATCGCTTCCTGGAGGCCGCAGAATCTAGTCAGGATCCTGCCGA<br>ACAGGTGAGGGCCCTATACGCCTTTCATCTGAACGCACCCGCGGTGCGAAGCATCGCCAACAAGGCAGT<br>CCAGCGATCCGACAGCCAAGAATGGCTTATAAAGGAACTGGACGCTGTGGACCACCTGGAGTTTAACAA<br>GGCCTTTCCCTTCTTCTCTGATACGGGAAGAAGAAAAAGAAAGGGGCTAACTCGAATGGCTCCGTC<br>CGAGGAGGAGTACACCGAGACTGAGAGCATCCAGCAGCCCGAGGACGCTGAGCAAGAGGTTAATGCTC<br>AGGAAGGCAACGGGGCCTCGAAGAACCAGAAGAAGTTTCAGAGAATCCCCCGATTCTTCGGCGAGGGG<br>AGTCGCAGCGAGTATCGCATCCTCACTGAAGCCCCGCAGTACTTCGACATGTTCTGTAACAACATGCGG<br>GCCATCTTTATGCAATTAGAATCCCAACCGCGTAAAGCTCCCAGGGATTTTAAGTGTTTCCTGCAGAATC<br>GGCTGCAGAAATTGTATAAGCAGATTCCTGAACGCTCGATCCAACAAGTGCCGGGCATTACTAGAGT<br>CCGTATTGATTAGTTGGGGAGAGTTTTACACCTACGGGCTAACGAGAAAAAATTTCGACTGCGTCATG<br>AAGCTTCTGAGCGCTCCTCGGACCCAGATTACGTGGTGCAACAGGCGCTGGAGATCGCTCGGAGGCTGT<br>TTCTCTTCGGCTTTGAGTGGAGGGACTGTAGCGCAGGTGAAAGAGTGGATCTGGTCGAAATACATAAGA<br>AAGCCATATCTTTCCTGTTGGCCATCACTCAGGCTGAGGTGTCTGTGGGCAGCTATAACTGGCTGGGCAA<br>TTCTACCGTGAGTCGGTACCTGTCCGTGGCAGGGACTGATACCCTTTACGGCACCCAGCTGGAAGAATTC<br>TTAAATGCAACCGTGTTATCTCAGATGCGGGGCTGGCTATCAGGTTATCATCTCAGGAACTGAAGGAT<br>GGATTTGACGTACAGCTGGAGTCTAGTTGCCAGGATAATCTGCAACACTTGCTCGTGTACAGGGCTTCAC<br>GAGACCTTGCCGCCTGCAAGCGCGCTACTTGTCCAGCTGAGTTGGATCCTAAGATTCTGGTACTGCCCGT<br>GGGGGCCTTTATCGCTAGCGTGATGAAAATGATTGAAAGAGGGGATGAGCCTTTAGCTGGAGCTTATCT<br>GAGACACAGACCCCATAGTTTCGGGTGGCAGATCCGCGTTCGAGGTGTGGCAGAGGTGGGAATGGACC<br>AAGGGACCGCCCTGGCGTTCCAGAAACCGACCGAGAGCGAACCCTTCAAGATAAAGCCGTTTTCCGCTC<br>AATACGGCCCCGTTCTATGGCTGAACAGCTCCAGTTATAGCCAGAGCCAGTACGCAGCGGGTTCCTATC<br>ACAGCCCAAGAACTGGAGTATGCGGGTGCTGCCACAGGCCGGCTCAGTGCGGGTAGAACAGCGCGTCG<br>CCTTGATTTGGAATCTCCAGGCCGGAAAGATGAGGCTGGAACGGAGCGGAGCGCGGGCTTTCTTCATGC<br>CCGTCCCATTCAGTTTCCGCCCCAGTGGCAGCGGCGACGAGGCAGTCCTGGCTCCAAATAGGTACCTGG<br>GACTCTTTCCACACAGCGGCGGCATAGAGTACGCTGTGGTCGATGTTCTTGACTCTGCCGGCTTCAAAAT<br>ACTCGAGAGAGGAACAATAGCCGTCAATGGCTTCTCCCAGAAACGAGGAGAAAGACAAGAGGAAGCCC |

TABLE 5-continued

| SEQ ID NO | Sequence |
|---|---|
| | ATCGCGAAAAACAAAGACGCGGTATCTCCGATATTGGGCGCAAGAAGCCAGTCCAGGCCGAAGTCGAT<br>GCGGCCAACGAGCTCCATCGAAAATACACCGATGTTGCTACTCGGCTGGGGTGTCGAATTGTCGTTCAA<br>TGGGCACCCCAACCCAAACCAGGCACTGCGCCGACCGCTCAGACTGTGTACGCTAGGGCCGTGAGGACT<br>GAAGCACCAAGATCCGGCAATCAGGAAGATCACGCCAGGATGAAATCTTCCTGGGGATACACATGGGG<br>TACGTATTGGGAAAAAAGGAAGCCCGAGGACATCCTCGGCATTAGTACCCAGGTGTATTGGACAGGCGG<br>GATCGGCGAGTCCTGCCCGGCTGTCGCCGTCGCGCTATTGGGACACATCAGGGCCACCTCAACCCAGAC<br>TGAATGGGAGAAAGAGGAAGTCGTGTTTGGGCGATTGAAAAAGTTCTTCCCATCCTGA |
| SEQ ID NO: 165 | ATGGAGAAGCGCATCAATAAAATTCGCAAGAAGCTGTCTGCCGATAACGCCACAAAACCAGTTAGTCGA<br>AGCGGCCCAATGAAGACCCTGCTAGTTCGAGTGATGACTGATGATCTGAAGAAAAGGCTCGAAAAGCG<br>ACGCAAGAAGCCTGAGGTAATGCCTCAGGTTATAAGTAACAATGCAGCAAACAATCTGCGGATGCTGCT<br>TGACGATTACACAAAGATGAAGGAAGCCATTCTCCAGGTGTATTGGCAGGAGTTCAAGGATGATCACGT<br>AGGCCTGATGTGTAAATTCGCGCAACCTGCAAGCAAGAAGATCGACCAAAACAAGCTGAAACCCAGA<br>TGGATGAAAAAGGCAATTTAACAACCGCCGGATTCGCTTGTTCCCAGTGTGGGCAGCCACTGTTCGTGT<br>ACAAGTTAGAACAGGTGTCGGAAAAAGGAAAGGCATACACTAACTACTTTGGACGGTGCAATGTTGCA<br>GAACACGAAAAGCTGATACTGCTTGCCCAGCTTAAGCCCGAAAAAGACAGCGACGAAGCGGTGACCTA<br>CAGCCTGGGAAAATTCGGGCAGCGGGCACTGGACTTCTATTCTATCCACGTTACCAAGGAGAGCACCCA<br>CCCAGTGAAGCCGTTGGCCCAAATCGCTGGAAACCGGTACGCCAGCGGACCAGTCGGCAAGGCCCTGTC<br>CGATGCCTGTATGGGCACAATTGCTTCTTTCCTGTCCAAGTACCAGGACATCATAATCGAGCACCAAAA<br>GTTGTGAAAGGGAATCAGAAACGCCTGGAATCCCTTCGAGAACTGGCCGGCAAGGAGAACCTTGAGTA<br>CCCGTCCGTGACCCTGCCTCCACAGCCACATACCAAAGAGGGCGTAGACGCGTATAATGAGGTCATTGC<br>CCGCGTTCGCATGTGGGTTAATTTAAACCTGTGGCAGAAATTAAAACTAAGCCGAGATGATGCTAAACC<br>GTTACTGAGATTGAAGGGATTCCCTAGCTTTCCTGTGGTGGAGAGAAGGGAAAACGAGGTTGATTGGTG<br>GAATACTATTAATGAGGTGAAAAAGCTTATTGACGCCAAGAGGGATATGGGCAGGGTGTTCTGGAGCGG<br>GGTGACTGCCGAAAAGAGAAATACCATCCTCGAGGGATGACAATTACCTCCCCAACGAGAATGATCATAA<br>GAAAAGAGAGGGGAGCTTAGAGAATCCAAAGAAACCTGCAAAGAGGCAATTCGGTGATCTCCTGCTCT<br>ACCTCGAGAAGAAATACGCGGGGACTGGGGAAAAGTTTTTGACGAAGCCTGGGAGCGCATTGACAAG<br>AAGATCGCCGGGCTGACGTCTCACATTGAACGGGAAGAGGCACGGAATGCAGAGGACGCCCAGTCTAA<br>GGCCGTGCTGACTGACTGGCTGCGCGCAAAGGCCTCCTTCGTGCTCGAACGTCTGAAGGAAATGGATGA<br>GAAAGAGTTTTACGCGTGTGAAATACAGCTGCAGAAGTGGTACGGCGATCTAAGGGGAAATCCCTTCGC<br>AGTGGAAGCCGAGAATAGGGTAGTTGACATCAGTGGGTTCTCCATCGGCAGTGATGGACATTTATCCA<br>GTATAGAAACCTGCTCGCCTGGAAGTACTTAGAGAACGGCAAGAGAGAGTTCTATCTGCTGATGAACTA<br>CGGGAAAAAAGGTAGAATTCGCTTTACAGATGGCACCGACATAAAGAAGTCCGGAAAGTGGCAAGGCC<br>TCTTATACGGAGGCGGCAAAGCAAAGGTGATAGACTTGACTTTGACCCTGACGACGAACAGCTGATAA<br>TCTTGCCGCTGGCCTTTGGCACAAGACAAGGTAGGGAATTTATCTGGAATGATCTTCTTTCTCTCGAGAC<br>CGGGACTCATCAAGCTCGCAAACGGAAGGGTCATCGAGAAGACAATCTACAATAAAAAGATAGGCCGAG<br>ACGAGCCAGCCCTGTTTGTGGCTTTGACATTTGAGCGGAGAGGTCGTAGATCCCAGCAACATCAAAC<br>CCGTGAACCTCGATCGGTGTTGACAGGGGCGAGAACATCCCGGCGGTTATCGCACTGACGGATCCAGAAG<br>GATGTCCTCTGCCCGAGTTCAAAGATTCATCGGGAGGGCCAACCGACATTTTGAGGATAGGGGAGGGGT<br>ACAAGGAGAAGCAGCGAGCTATCCAGGCGGCCAAGAAGTGGAGCAACGAAGAGCTGGTGGTTATTCT<br>CGCAAGTTCGCTTCCAAAAGTCGTAACCTGGCTGACGATATGGTGCGCAATTCTGCCCGTGACCTTTTCT<br>ACCACGCCGTTACACACGACGCCGTGTTAGTGTTTGAAAATCTTAGTCGAGGCTTCGGGCGACAGGGGA<br>AGCGGACCTTTATGACCGAGAGACAGTATACAAAAATGGAGGATTGGCTGACCGCCAAACTGGCGTATG<br>AAGGACTCACATCCAAGACCTATCTCTCAAAAACTTTGGCCCAGTATACATCTAAGACGTGCAGTAACT<br>GTGGCTTCACCATTACCACAGCTGACTACGATGGCATGCTGGTCCGCTTAAAAAAGACATCTGACGGCT<br>GGGCTACTACCCTCAACAATAAAGAGCTCAAAGCCGAAGGACAAATTACCTATTATAACAGGTATAAAA<br>GACAGACTGTCGAGAAGGAGTTGAGCGCGGAGCTGGACCGCCATCAGAGGAGTCAGGGAACAACGAT<br>ATCTCTAAGTGGACTAAGGGACGCCGAGACGAGGCGTTGTTCTTGCTGAAAAAGCGGTTCTCTCATCGA<br>CCCGTGCAGGAGCAGTTCGTGTGTCTGGACTGCGGCCACGAGGTTCATGCTGATGAGCAAGCTGCTCTA<br>AATATTGCCCGTAGTTGGTTGTTCCTGAACAGCAATTCAACAGAGTTCAAGTCATACAAGAGCGGAAAG<br>CAGCCGTTTGTGGGCGCATGGCAGGCATTTTACAAAAGACGCCTGAAGGAAGTGTGGAAGCCAAACGCC |
| SEQ ID NO: 166 | ATGAAAAGGATTAACAAAATCCGAAGGCGGCTTGTAAAGGATTCTAACACCAAAAAGGCTGGCAAGAC<br>GGGGCCCATGAAAACATTACTCGTTAGAGTTATGACCCCCGAGGAGCGACTGGAAAATTTACG<br>CAAGAAGCCAGAGAACATACCTCAGCCAATTAGTAATACCTCTCGGGCAAACTCAAACAAGTTGCTTAC<br>TGATTACACGGAGATGAAAAAGGCCATACTGCATGTGTACTGGGAGGAGTTTCAAAAGGACCCTGTCGG<br>GCTAATGAGCAGGGTGGCTCAGCCTGCACCTAAAACATCGACCAGCGGAAACTCATCCCAGTTAAGGA<br>CGGAAATGAGAGATTGACAAGTTCAGGTTTCGCCTGCTCACAGTGCTGTCAACCGCTGTACGTTTATAAG<br>TTAGAACAAGTGAATGACAAAGGAAAGCCTCACACAAATTATTTTGGCCGGTGTAATGTCTCTGAGCAT<br>GAGCGTCTGATTCTGTTGTCCCCGCATAAACCGGAAGCTAATGACGAGCTCGTAACCTACAGCTTGGGG<br>AAGTTTGGCCAAAGAGCATTGGACTTCTATTCAATCCATGTGACCCGCGAATCAATCATCCCGTCAAGC<br>CCTTGGAGCAGATAGGGGCAATAGTTGCGCTTCTGGCCCTGTGGGCAAAGCCCTGTCCGACGCCTGTA<br>TGGGAGCCGTGGCTTCATTCCTGACCAAATATCAGGATCATCTTCGGAGCACTGAAGTGATCAGAA<br>AAAATGAAAAAGGTTAGCAAACCTCAAGGATATTGCAAGCGCTAACGGCTTGGCTTTTCCTAAAATCA<br>CACTTCCACCTCAGCCTCACACAAAGGAAGGCATCGAGGCATACAACAATGTGGTGGCCAGATCGTCA<br>TCTGGGTTAACTTAAACCTGTGGCAGAAACTTAAAATTGGCAGGGATGAGGCAAAACCCTTACAGCGCC<br>TGAAAGGATTCCCCAGCTTTCACTGGTGGAGCGCCAGGCTAACGAAGTGGACTGGTGGATATGGTGT<br>GTAACGTCAAGAAGCTCATCAATGAAAAGAAAGAGGACGGTAAAGTCTTCTGGCAGAACCTCGCCGGTT<br>ACAAACGGCAGGAGGCGCTGTTACCTTATCTGTCGAGTGAAGAGGACCGGAAAAAAGGCAAGAAATTT<br>GCTCGTTATCAGTTTGGTGATTTGCTCCTACATTTGGAAGAAGCACGGCGAGGACTGGGGAAAAGTA<br>TACGATGAGGCCTGGGAGAGGGATTGACAAAAAGGTGGAAGGCTGTCAAAGCACATCAGAAGA<br>AGAGCGCAGAAGCGAGGACGCCCAATCCAAAGCAGCGCTGACTGACTGGCTGCGGGCGAAGGCCAGTT<br>TTGTAATCGAAGGCCTTAAAGAAGCCGACAAGGATGAATTCTGCAGATGCGAATTAAAACTCCAGAAGT<br>GGTACGGCGATCTCCGAGGTAAGCCTTTCGCAATCGAGGCCGAGAATTCCATACTGGACATTAGTGGAT<br>TCAGTAAACAGTATAATTGTGCCTTTATATGGCAGAAGGATGGTGTCAAGAAACTCAACCTGTACCTTAT<br>TATTAATTATTTCAAAGGCGGGAAACTGAGATTTAAGGAAGATAAAGCCTGAAGCCTTTGAGGCGAACCG |

TABLE 5-continued

| SEQ ID NO | Sequence |
|---|---|
| | ATTCTACACAGTTATTAACAAGAAATCTGGTGAAATTGTACCCATGGAGGTAAACTTCAACTTCGATGAT<br>CCCAATCTGATTATATTGCCACTAGCTTTTGGCAAGCGGCAGGGTAGGGAATTCATTTGGAACGATTTGC<br>TTTCACTGGAAACAGGGTCCCTTAAGCTGGCAAACGGGAGAGTGATTGAAAAGACATTGTACAATCGGA<br>GGACACGTCAGGATGAACCTGCCCTTTTCGTGGCTCTGACATTCGAGCGCAGGGAGGTTCTGGACTCTA<br>GCAATATCAAGCCAATGAACCTGATCGGCATAGACCGAGGAGAGAATATTCCGGCTGTGATCGCACTCA<br>CCGATCCCGAAGGATGTCCCCTTTCTCGGTTCAAGGACTCCTTAGGCAATCCAACTCATATCCTGAGAAT<br>CGGCGAGTCATACAAGGAGAAGCAGCGAACAATTCAGGCCGCCAAGGAAGTCGAGCAGAGGCGAGCTG<br>GCGGCTACAGCCGTAAATACGCTAGTAAAGCTAAGAACCTGGCCGACGATATGGTGCGCAATACTGCTA<br>GAGACCTGCTGTACTATGCAGTGACGCAGGACGCAATGCTGATATTCGAGAATCTGTCCAGAGGATTCG<br>GAAGGCAGGGCAAGCGGACGTTCATGGCCGAGCGCCAGTATACAAGGATGGAGGATTGGTTAACGGCC<br>AAGCTTGCCTATGAGGGGCTACCTAGTAAGACCTATCTGTCTAAGACGCTGGCTCAATACACCAGTAAG<br>ACCTGCTCAAACTGTGGCTTTACAATCACTTCTGCTGATTATGATAGAGTGCTCGAGAAGCTAAAAAAA<br>ACTGCCACCGGCTGGATGACTACTATTAATGGGAAGGAACTGAAAGTGGAAGGACAGATTACCTATTAT<br>AATCGCTACAAGCGTCAAAACGTCGTCAAGGACCTGTCGGTGGAATTGGACAGACTCAGTGAAGAGTCC<br>GTGAACAATGATATCAGCTCCTGGACAAAAGGGCGCAGTGGGGAGGCACTCAGCTTGCTTAAAAAGAG<br>GTTTTCACATCGGCCGGTCCAGGAGAAATTTGTCTGCCTGAACTGCGGATTCGAGACACACGCCGACGA<br>GCAGGCAGCACTGAACATTGCCAGATCCTGGCTGTTCCTTAGGTCCCAGGAATATAAGAAGTACCAGAC<br>TAACAAAACCACGGGAAACACAGATAAAAGGGCCTTTGTCGAAACTTGGCAATCCTTTTACCGGAAGAA<br>GTTAAAGGAAGTGTGGAAGCCC |
| SEQ ID NO: 167 | ATGGATAAGAAATACTCAATAGGCTTAGCAATCGGCACAAATAGCGTCGGATGGGCGGTGATCACTGAT<br>GAATATAAGGTTCCGTCTAAAAAGTTCAAGGTTCTGGGAAATACAGACCGCCACAGTATCAAAAAAAAT<br>CTTATAGGGGCTCTTTTATTTGACAGTGGAGAGACAGCGGAAGCGACTCGTCTCAAACGGACAGCTCGT<br>AGAAGGTATACACGTCGGAAGAATCGTATTTGTTATCTACAGGAGATTTTTCAAATGAGATGGCGAAA<br>GTAGATGATAGTTTCTTTCATCGACTTGAAGAGTCTTTTTGGTGGAAGAAGACAAGAAGCATGAACGTC<br>ATCCTATTTTGGAAATATAGTAGATGAAGTTGCTTATCATGAGAAATATCCAACTATCTATCATCTGCG<br>AAAAAAATTGGTAGATTCTACTGATAAAGCGGATTTGCGCTTAATCTATTTGGCCTTAGCGCATATGATT<br>AAGTTTCGTGGTCATTTTTTGATTGAGGGAGATTTAAATCCTGATAATAGTGATGTGGACAAACTATTTA<br>TCCAGTTGGTACAAACCTACAATCAATTATTTGAAGAAAACCTATTAACGCAAGTGGAGTAGATGCTA<br>AAGCGATTCTTTCTGCACGATTGAGTAAATCAAGACGATTAGAAAATCTCATTGCTCAGCTCCCCGGTGA<br>GAAGAAAAATGGCTTATTTGGGAATCTCATTGCTTTGTCATTGGGTTTGACCCCTAATTTTAAATCAAAT<br>TTTGATTTGGCAGAAGATGCTAAATTACAGCTTTCAAAAGATACTTACGATGATGATTTAGATAATTTAT<br>TGGCGCAAATTGGAGATCAATATGCTGATTTGTTTTTGGCAGCTAAGAATTTATCAGATGCTATTTTACT<br>TTCAGATATCCTAAGAGTAAATACTGAAATAACTAAGGCTCCCCTATCAGCTTCAATGATTAAACGCTAC<br>GATGAACATCATCAAGACTTGACTCTTTTAAAAGCTTTAGTTCGACAACAACTTCCAGAAAAGTATAAA<br>GAAATCTTTTTTGATCAATCAAAAAACGGATATGCAGGTTATATTGATGGGGGAGCTAGCCAAGAAGAA<br>TTTTATAAATTTATCAAACCAATTTTAGAAAAAATGGATGGTACTGAGGAATTATTGGTGAAACTAAATC<br>GTGAAGATTTGCTGCGCAAGCAACGGACCTTTGACAACGGCTCTATTCCCCATCAAATTCACTTGGGTGA<br>GCTGCATGCTATTTTGAGAAGACAAGAAGACTTTTATCCATTTTTAAAAGACAATCGTGAGAAGGATTGA<br>AAAAATCTTGACTTTTCGAATTCCTTATTATGTTGGTCCATTGGCGCGTGGCAATAGTCGTTTTGCATGGA<br>TGACTCGGAAGTCTGAAGAAACAATTACCCCATGGAATTTTGAAGAAGTTGTCGATAAAGGTGCTTCAG<br>CTCAATCATTTATTGAACGCATGACAAACTTTGATAAAAATCTTCCAAATGAGAAAGTACTACCAAAAC<br>ATAGTTTGCTTTATGAGTATTTTACGGTTTATAACGAATTGACAAAGGTCAAATATGTTACTGAAGGAAT<br>GCGAAAACCAGCATTTCTTTCAGGTGAACAGAAGAAAGCCATTGTTGATTTACTCTTCAAAACAAATCG<br>AAAAGTAACCGTTAAGCAATTAAAAGAAGATTATTTCAAAAAAATAGAATGTTTTGATAGTGTTGAAAT<br>TTCAGGAGTTGAAGATAGATTTAATGCTTCATTAGGTACCTACCATGATTTGCTAAAAATTATTAAAGAT<br>AAAGATTTTTTGGATAATGAAGAAAATGAAGATATCTTAGAGGATATTGTTTTAACATTGACCTTATTTG<br>AAGATAGGGAGATGATTGAGGAAAGACTTAAAACATATGCTCACCTCTTTGATGATAAGGTGATGAAAC<br>AGCTTAAACGTCGCCGTTATACTGGTTGGGGACGTTTGTCTCGAAAATTGATTAATGGTATTAGGGATAA<br>GCAATCTGGCAAAACAATATTAGATTTTTTGAAATCAGATGGTTTTGCCAATCGCAATTTTATGCAGCTG<br>ATCCATGATGATAGTTTGACATTTAAAGAAGACATTCAAAAAGCACAAGTGTCTGGACAAGGCGATAGT<br>TTACATGAACATATTGCAAATTTAGCTGGTAGCCCTGCTATTAAAAAGGTATTTTACAGACTGTAAAAG<br>TTGTTGATGAATTGGTCAAAGTAATGGGGCGGCATAAGCCAGAAAATATCGTTATTGAAATGGCACGTG<br>AAAATCAGACAACTCAAAAGGGCCAGAAAAATTCGCGAGAGGCGTATGAACGAATCGAAGAAGGTATC<br>AAAGAATTAGGAAGTCAGATTCTTAAAGAGCATCCTGTTGAAAATACTCAATTGCAAATGAAAAGCTC<br>TATCTCTATTATCTCCAAAATGGAAGAGACATGTATGTGGACCAAGAATTAGATATTAATCGTTTAAGTG<br>ATTATGATGTCGATCACATTGTTCCACAAAGTTTCCTTAAAGACGATTCAATAGACAATAAGGTCTTAAC<br>GCGTTCTGATAAAAATCGTGGTAAATCGGATAACGTTCCAAGTGAAGAAGTAGTCAAAAAGATGAAAA<br>ACTATTGGAGACAACTTCTAAACGCCAAGTTAATCACTCAACGTAAGTTTGATAATTTAACGAAAGCTG<br>AACGTGGAGGTTTGAGTGAACTTGATAAAGCTGGTTTTATCAAACGCCAATTGGTTGAAACTCGCCAAA<br>TCACTAAGCATGTGGCACAAATTTTGGATAGTCGCATGAATACTAAATACGATGAAAATGATAAACTTA<br>TTCGAGAGGTTAAAGTGATTACCTTAAAATCTAAATTAGTTTCTGACTTCCGAAAAGATTTCCAATTCTA<br>TAAAGTACGTGAGATTAACAATTACCATCATGCCCATGATGCGTATCTAAATGCCGTCGTTGGAACTGCT<br>TTGATTAAGAAATATCCAAAACTTGAATCGGAGTTTGTCTATGGTGATTATAAAGTTTATGATGTTCGTA<br>AAATGATTGCTAAGTCTGAGCAAGAATAGGCAAAGCAACCGCAAATATTTCTTTTACTCTAATATCA<br>TGAACTTCTTCAAAACAGAAATTACACTTGCAAATGGAGAGATTCGCAAACGCCCTCTAATCGAAACTA<br>ATGGGGAAACTGGAGAAATTGTCTGGGATAAAGGGCGAGATTTTGCTACAGTGCGCAAAGTATTGTCCA<br>TGCCCCAAGTCAATATTGTCAAGAAAACAGAAGTACAGACAGGCGGATTCTCCAAGGAGTCAATTTTAC<br>CAAAAAGAAATTCGGACAAGCTTATTGCTCGTAAAAAAGACTGGGATCCAAAAAAATATGGTGGTTTTG<br>ATAGTCCAACGGTAGCTTATTCAGTCCTAGTGGTTGCTAAGGTGGAAAAAGGGAAATCGAAGAAGTTAA<br>AATCGTTAAAGAGTTACTAGGGATCACAATTATGGAAAGAGTTCCTTTGAAAAAATCCATTGACTTGACT<br>TTTTGAGAGCTAAAGGATATAAGGAAGTTAAAAAAGACTTAATCATTAAACTACCTAAATATAGTCTTTT<br>TGAGTTAGAAAACGGTCGTAAACGGATGCTGGCTAGTGCCGGAGAATTACAAAAAGGAAATGAGCTGG<br>CTCTGCCAAGCAAATATGTGAATTTTTTATATTTAGCTAGTCATTATGAAAAGTTGAAGGGTAGTCCAGA<br>AGATAACGAACAAAAACAATTGTTTGTGGAGCAGCATAAGCATTATTTAGATGAGATTATTGAGCAAAT<br>CAGTGAATTTTCTAAGCGTGTTATTTTAGCAGATGCCAATTTAGATAAAGTTCTTAGTGCATATAACAAA |

| SEQ ID NO | Sequence |
|---|---|
| | CATAGAGACAAACCAATACGTGAACAAGCAGAAAATATTATTCATTTATTTACGTTGACGAATCTTGGA GCTCCCGCTGCTTTTAAATATTTTGATACAACAATTGATCGTAAACGATATACGTCTACAAAAGAAGTTT TAGATGCCACTCTTATCCATCAATCCATCACTGGTCTTTATGAAACACGCATTGATTTGAGTCAGCTAGG AGGTGACTGA |
| SEQ ID NO: 168 | ATGGATAAGAAGTATTCAATTGGACTTGCGATTGGCACTAACAGTGTGGGCTGGGCGGTGATTACAGAC GAGTATAAGGTGCCGTCAAAAAAGTTTAAAGTTCTGGGCAACACTGATCGCCATTCCATCAAGAAAAAC CTAATCGGGGCCCTTCTTTTTGATAGTGGCGAAACGGCCGAGGCGACGCGTCTAAAACGTACCGCGCGG CGTCGCTACACCCGACGAAAAACCGTATTTGTTACCTTCAGGAGATCTTCAGTAACGAAATGGCTAAG GTGGACGATTCATTCTTCCACCGTCTGGAGGAGTCCTTTTTAGTTGAAGAAGACAAGAAGCATGAGCGA CACCCCAATTTTTGGTAACATTGTCGACGAAGTCGCCTATCACGAAAAATATCCGACCATTTATCACCTGC GCAAAAAACTGGTCGATAGCACGGATAAAGCGGATCTGCGGCTTATTTACCTGGCGCTTGCCCACATGA TCAAGTTCCGCGGCCACTTCCTGATAGAAGGAGACCTGAACCCGGATAATAGCGATGTAGACAAACTGT TTATTCAGCTGGTCCAGACCTACAACCAGCTGTTTGAAGAAAATCCGATTAATGCGTCAGGCGTGGATG CGAAAGCGATACTGAGTGCCCGCCTGTCGAAATCTCGCCGTCTCGAAATCTGATTGCACAGCTGCCCG GCGAAAAAAAAACGGTCTTTTTGGCAATCTGATCGCGCTGTCACTGGGCCTGACACCAAATTTTAAGA GCAACTTCGACCTGGCAGAGGATGCGAAGCTTCAACTGTCGAGGACACCTATGACGATGATCTGGATA ATCTTCTGGCACAAATCGGTGATCAGTATGCGGATTTATTCCTTGCAGCGAAAAACCTATCTGACGCAAT TCTGTTGAGCGATATCCTCCGCGTCAACACCGAAATCACTAAAGCCCCCTGTCAGCGTCGATGATTAAA CGTTATGATGAGCACCATCAGGATCTGACCTTGCTAAAGGCGCTGGTGCACAGCAGCTTCCCGAAAAA TATAAAGAGATCTTTTTTGATCAATCGAAGAATGGTTATGCCGGATACATTGATGGCGGAGCCAGTCAG GAAGAATTTTACAAATTCATCAAACCGATCCTGGAAAAAATGGATGGCACAGAAGAACTGCTTGTGAAA TTGAACCGGGAAGATTTACTGCGCAAACAGCGTACGTTCGACAACGGCTCCATACCCCATCAGATTCAC TTAGGTGAGCTGCATGCAATACTCCGTCGCCAGGAAGATTTTTATCCATTTTTAAAAGACAACCGTGAGA AGATTGAAAAAATTTTAACTTTTCGTATTCCATATTACGTCGGGCCTTTGGCCCGAGGTAACTCTCGATT CGCCTGGATGACGAGAAAAAGCGAGGAGACCATCACTCCGGAATTTTGAAGAGGTTGTTGATAAAG GCGCGAGCGCCCAGTCGTTTATCGAACGTATGACCAACTTTGATAAAAATCTGCCGAATGAAAAAGTGC TTCCGAAGCATTCTCTGTTGTATGAATATTTCACTGTGTACAATGAGTTAACGAAAGTGAAATATGTGAC CGAAGGCATGCGGAAACCTGCTTTTCTGTCCGGAGAACGAAAAAAGCAATTGTGGACCTGCTGTTCAA AACGAACCGGAAAGTAACTGTGAAGCAGCTGAAAGAGGACTACTTCAAAAAAATCGAATGCTTCGACT CAGTAGAGATCTCTGGTGTTGAAGATCGCTTCAACGCGAGTCTGGGAACGTACCATGATTGTTGAAAA TCATCAAAGATAAAGACTTTCTGGATAACGAAGAGAATGAGGACATTCTTGAAGATATTGTTTTGACAC TGACTCTGTTTGAGGATCGCGAAATGATTGAAGAGCGCCTGAAAACGTATGCCCATTTATTCGATGACA AAGTCATGAAGCAGCTGAAACGTCGCCGCTATACTGGGTGGGGCGACTTTCACGTAAATTGATCAATG GTATAAGAGACAAACAGAGCGGCAAAACTATCTTAGATTTCCTGAAGAGTGATGGATTTGCCAACCGGA ATTTTTATGCAGCTTATACATGATGACTCGCTAACGTTTAAAGAAGACATTCAGAAGGCGCAGGTCAGCG GCCAGGGTGATTCGCTGCATGAACACATTGCAAATCTTGCCGGATCGCCAGCGATCAAAAAAGGCATCC TTCAGACAGTAAAAGTTGTGGATGAACTGGTGAAAGTAATTGGTCGTCACAAGCCAGAAAATATTGTGA TCGAAATGGCCCGGGAAAATCAGACTACTCAAAAAGGTCAGAAAAATTCTCGCGAGCGTATGAAACGT ATTGAAGAAGGCATCAAAGAGCTAGGCAGCCAGATATTAAAGGAACATCCGGTTGAGAACACTCAGCT GCAGAATGAAAAACTGTATCTGTATTATCTTCAGAACGGCCGTGACATGTATGTTGATCAAGAACTGGA TATCAATCGCTTGTCCGATTATGACGTGGATCATATTGTTCCGCAAAGCTTTCTGAAAGACGATTCTATT GACAATAAGTACTGACACGTTCGGACAAAAACCGTGGTAAAAGCGATAACGTACCGTCGGAAGAAGT TGTTAAGAAAATGAAAAATTATTGGCGCCAACTCCTGAATGCTAAATTGATTACCCAGCGGAAATTTGA TAACTTAACCAAAGCCGAGCGGGGTGGCTTAAGTGAACTGGATAAAGCGGGTTTTATTAAACGCCAACT GGTAGAACCCGCCAGATAACGAAACATGTAGCTCAAATCCTCGATAGTCGATGAATACGAAATATGA CGAAAATGATAAATTGATCCGTGAAGTAAAAGTGATTACTCTTAAAAGCAAATTGGTATCTGATTTTCG GAAAGATTTCCAATTCTATAAGGTGAGAGAAATTAACAATTACCATCATGCACATGATGCGTATTTAAA TGCAGTTGTTGGCACCGCCTTAATCAAAAATATCCGAATTAGAATCTGAGTTCGTGTATGGTGATTAT AAAGTTTATGATGTTCGAAAATGATTGCTAAGTCTGAACAGGAATCGGCAAAGCGACCGCAAAGTAT TTTTTTTATAGCAATATTATGAATTTTTTTAAAACTGAGATTACCCTGGCGAATGGCGAAATTCGCAAAC GTCCTCTGATTGAAACCAATGGCGAAACCGGCGAGATAGTATGGGACAAGGGCCGTGATTTTGCGACCG TCCGGAAAGTCCTGTCAATGCCGCAGGTGAATATTGTCAAGAAAACAGAAGTTCAGACAGGCGGTTTTA GTAAAGAGTCTATTCTGCCCAAACGTAATTCGGATAAATTGATTGCCCGCAGAAGAAAGATTTGGGATCCGA AGAAATATGGTGGATTCGATTCTCCGACGGTCGCCTATAGCGTTCTAGTCGTCGCCAAGGTCGAAAAG GTAAATCCAAAAAACTGAAATCTGTGAAAGAACTGTTAGGCATTACAATCATGGAACGTAGTAGTTTTG AAAAGAACCCGATCGACTTCCTCGAGGCGAAAGGCTACAAAGAAGTCAAGAAGGATTTGATTATTAAA CTCCCAAAATATTCATTATTTGAGTTAGAAAACGGTAGGAAGCGTATGCTGGCGAGTGCTGGGGAATTA CAGAAAGGGAATGAGTTAGCACTGCCGTCAAAATATGTGAACTTTCTGTATCTGGCCTCCCATTACGAG AAACTGAAAGGTAGCCCGGAAGATAATGAACAGAAACAACTATTTGTCGAGCAACACAAACATTATCT GGATGAAATTATTGAACAGATTAGTGAATTCTCTAAACGTGTTATTTTAGCGGATGCCAACCTTGACAAG GTGCTGAGCGCATATAATAAACACCGTGATAAACCCATTCGTGAACAGGCTGAAAATATCATACATCTG TTCACGTTAACCAACTTGGGAGCTCCTGCCGCTTTTAAATATTTCGATACACACAATTGACCGCAAACGTT ATACGTCTACAAAAGAGGTGCTCGATCGACCCTGATCCACCAGTCTATTACAGGCCTGTATGAAACTC GTATCGACCTGTCACAACTGGGCGGCGACTGA |
| SEQ ID NO: 169 | ATGGACAAGAAATATTCAATCGGTTTAGCAATAGGAACTAACTCAGTAGGTTGGGCTGTAATTACAGAC GAATACAAGGTACCGTCCAAAAAGTTTAAGGTGTTGGGGAACACAGATAGACACTCTATAAAAAAAAA TTTAATAGGCGCTTTACTTTTCGATTCAGGCGAAACTGCAGAAGCGACACGTCTGAAGAGAACCGCTAG ACGTAGATACACGAGGAGAAAGAACAGAATATGTTACCTACAAGAAATTTTTTCTAATGAGATGGCTAA GGTGGATGATTCGTTTTTCATAGACGTCGAAGAATCTTTCTTAGTTGAAGAAGATAAAAAACACGAAAG GCATCCTATCTTTGGAAACATAGTTGATGAGGTGGCTTACCATGAAAAATATCCCACTATATATCACCTTT AGAAAAAGTTGGTTGATTCAACCGACAAAGCGGATCTAAGGTTAATTTACCTCGCGTTGGCTCACATG ATAAAATTTAGAGGACATTTCTTGATCGAAGGTGATTTAAATCCCGATAACTCTGATGTAGATAAACTGT TCATCCAGTTGGTTCAAACATATAATCAGTTGTTCGAAGAGAACCCCATTAACGCATCAGGTGTTGATGC TAAAGCAATCTTATCAGCAAGGTTGAGCAAGAGCAGACGTCTGGAAAACTTGATTGCCCAATTGCCAGG |

TABLE 5-continued

| SEQ ID NO | Sequence |
|---|---|
| | TGAAAAGAAGAACGGTCTTTTTGGAAATTTAATTGCACTTTCACTTGGGTTGACACCGAATTTTAAAAGC<br>AATTTCGACCTCGCTGAGGATGCTAAACTCCAGTTATCTAAGGATACATATGACGATGATTTGGATAATC<br>TATTTGGCCCAGATAGGTGATCAGTATGCAGATTTGTTTTTGGCAGCTAAGAATTTATCAGATGCAATTCT<br>ACTGAGCGATATTTTAAGGGTGAATACAGAAATAACTAAAGCACCTTTGTCTGCATCTATGATAAAAAG<br>ATACGATGAACACCATCAAGATCTCACACTATTAAAAGCTTTAGTTAGACAACAATTACCAGAAAAATA<br>TAAAGAAATCTTTTTCGATCAGTCCAAGAACGGATACGCCGGCTATATAGATGGCGGTGCCTCCCAAGA<br>AGAATTTTACAAATTTATCAAACCCATTTTGGAAAAGATGGATGGTACTGAAGAATTATTGGTCAAATTA<br>AACAGGGAAGATTTATTAAGAAAACAAAGGACCTTTGATAATGGTTCTATTCCACACCAAATCCATCTA<br>GGGGAATTACATGCGATTCTTAGAAGACAAGAAGATTTTTATCCATTCTTGAAAGATAACAGGGAAAAG<br>ATAGAGAAAATCTTAACTTTTAGAATTCCCTACTACGTCGGGCCCTTAGCTAGGGGGAATTCTAGATTCG<br>CCTGGATGACACGCAAATCAGAAGAAACAATTACGCCTTGGAATTTTGAAGAAGTTGTTGATAAAGGAG<br>CCTCTGCTCAATCTTTTATTGAACGAATGACCAATTTTGATAAGAATTTACCCAATGAAAAGGTCTTACC<br>CAAACATTCACTCCTATACGAGTACTTTACTGTTTACAATGAGTTGACAAAAGTGAAGTATGTTACCGAG<br>GGTATGCGAAAACCTGCTTTCTTGAGTGGTGAACAAAAGAAGGCCATTGTTGACTTGTTATTCAAAACTA<br>ACAGAAGGTCACTGTGAAGCAGCTTAAAGAAGATTATTTCAAAAGATCGAATGTTTCGACTCGGTAG<br>AAATTAGTGGTGTGGAAGATAGATTTAATGCTTCTCTTGGAACATATCATGATCTACTAAAGATCATCAA<br>AGATAAGATTTCTTGGACAATGAAGAAAATGAAGATATTCTTGAAGACATCGTGTTGACACTTACATT<br>GTTTGAGGACAGAGAAATGATTGAAGAAAGGCTGAAGACCTACGCCCATTTGTTTGATGATAAAGTCAT<br>GAAACAGTTAAAGAGGAGAAGGTATACCGGATGGGTAGGCTGTCTCGCAAATTGATTAATGGTATTCG<br>TGATAAACAATCGGGTAAAACAATCCTAGATTTCCTGAAGTCCGATGGTTTCGCCAACAGGAATTTATG<br>CAATTGATTCATGACGATTCTTTGACTTTTAAAGAGGATATTCAGAAGACACAGGTCTCAGGACAGGGC<br>GATTCACTCCATGAACATATAGCTAACCTGGCTGGCTCCCCTGCTATTAAGAAAGGTATCTTGCAAACCG<br>TCAAAGTAGTAGACGAACTTGTTAAAGTTATGGGAAGACACAAACCTGAAAATATCGTTATTGAAATGG<br>CTCGCGAAAACCAGACAACACAAAAGGGTCAAAAGAATTCGAGAGAGAATGAAGCGTATCGAAGA<br>AGGTATTAAAGAACTTGGGTCCCAAATACTTAAAGAACATCCAGTAGAAACATCTCAGCTTCAAAATGA<br>AAAATTATACTTATATTATCTTCAGAATGGCCGCGATATGTATGTTGACCAAGAGTTAGATATAAATAGG<br>TTGTCTGATTACGACGTGGATCATATTGTACCTCAATCTTTTCTAAAAGATGATTCAATTGATAATAAGG<br>TATTAACGAGAAGTGATAAAAATAGAGGTAAATCTGACAACGTGCCAAGCGAAGAGGTGGTGAAGAAA<br>ATGAAAAATTATTGGCGTCAACTGTTGAACGCCAAGTTAATTACGCAGAAGAAAGTTTGATAATCTAACA<br>AAAGCTGAAAGAGGAGGCCTATCTGAGTTAGATAAGGCCGGTTTTATCAAACGTCAGTTAGTTGAAACC<br>AGGCAAATCACGAAGCACGTTGCCCAAATTCTAGATTCAAGGATGAATACCAAATACGATGAAAACGAT<br>AAACTGATTCGGGAAGTCAAGGTTATAACTCTAAAAAGCAAACTAGTTTCAGATTTTCGCAAAGATTTTC<br>AATTTTACAAAGTTCGAGAAATCAATAATTATCATCATGCTCACGACGCGTACTTGAACGCGGTCGTTGG<br>TACAGCTTTAATAAAGAAATATCCTAAACTGGAATCGGAATTTGTATATGGGGATTACAAAGTATACGA<br>CGTGAGAAAGATGATCGCTAAATCTGAACAAGAAATTGGGAAAGCAACTGCCAAATATTTTTTTACAG<br>CAACATAATGAATTTTTTTAAAACGGAAATTACATTGGCAAATGGCGAAATTAGAAAGCGCCCATTGAT<br>AGAGACCAATGGAGAGACTGGGGAAATCGTGTGGGATAAAGGACGTGATTTTGCCACAGTGAGGAAAG<br>TGTTAAGTATGCCACAAGTTAATATTGTAAAAAAGACCGAGGTCCAAACGGGTGGATTTAGCAAAGAT<br>CAATTTTACCTAAGAGAAATTCAGATAAATTAATTGCCCGCAAAAAGGATTGGGATCCTAAAAAATATG<br>GTGGTTTTGATTCCCCAACAGTTGCTTACTCCGTCCTAGTTGTTGCTAAGGTTGAAAAAGGAAAGTCTAA<br>GAAACTTAAATCCGTAAAAGAGTTACTGGGAATTACAATAATGGAAAGATCCTCTTTCGAAAAGAACCC<br>TATTGACTTCTTGGAGGCGAAAGGTTATAAAGAAGTCAAAAAAGATTTGATCATAAAACTACAAAGTA<br>TTCTCTATTTGAATTGGAAAACGGCAGAAAAAGGATGTTGGCAAGCGCTGGTGAACTACAAAAGGGTAA<br>CGAATTGGCATTGCCGAGTAAATACGTGAATTTTCTATATTTGGCATCACATTACGAAAAGTTAAAGGG<br>ATCACCCGAGGATAACGAGCAGAAACAACTGTTTGTTGAACAACACAAACATTATCTTGATGAAATTAT<br>AGAACAAATTAGTGAGTTCAGTAAGAGAGTTATTTTAGCCGATGCAAATTTAGACAAAGTTTTATCTGCT<br>TATAACAAACATAGAGATAAGCCTATAAGGGAACAAGCCGAAAATATTATTCATTTGTTTACGTTAACA<br>AATTTAGGGGCACCAGCAGCATTCAAGTACTTCGATACGACTATCGATCGTAAGCGTTACACATCTACC<br>AAAGAAGTTCTTGATGCAACTTTGATTCATCAATCTATAACAGGCTTATATGAAACTAGAATCGATCTGT<br>CACAACTTGGTGGTGACTAA |
| SEQ ID NO: 170 | ATGGACAAGAAGTACTCAATTGGGCTTGCTATCGGCACTAACAGCGTTGGCTGGGCGGTCATCACAGAC<br>GAATATAAGGTCCCATCAAAGAAATTCAAAGTCCTTGGCAATACGGACCGACATTCAATCAAGAAGAAC<br>CTGATTGGAGCTCTGCTGTTTGATTCCGGTGAAACCGCCGAGGCAACACGATTGAAACGTACCGCTCGT<br>AGGAGGTATACGCGGCGGAAAAATAGGATCTGCTATCTGCAGGAAATATTTAGCAACGAAATGGCCAA<br>GGTAGACGACAGCTTCTTCCACCGGCTCGAGGAATCTTTCCTCGTGGAAGAAGCAAAAAGCACGAGCG<br>CCACCCCATTTTCGGCAATATCGTGGACGAGGTAGCTTACCATGAAAAGTATCCAACTATTTACCACTTA<br>CGTAAGAAGTTAGTGGACAGCACCGATAAAGCCGACCTTCGCTGATTTACCTAGCACTTGCACACATG<br>ATTAAGTTCCGAGGCCACTTCTTGATAGAGGGAGACCTGAATCCTGACAATTCCGATGTGGATAAATTGT<br>TCATCCAGCTGGTACAGACATACAATCAGTTGTTTGAGGAAAATCCGATTAATGCCAGTGGCGTGGACG<br>CCAAGGCTATCCTGTCTGCTCGGCTTAGTAAGAGTAGACGCCTGGAAATCTAATCGCACAGCTGCCCG<br>GCGAAAAGAAAATGGACTGTTCGGTAATTTGATCGCCCTGAGCCTGGGCCTCACCCCTAACTTTAAGT<br>CTAACTTCGACCTGGCCGAAGATGCTAAGCTCCAGCTGTCCAAAGATACTTACGATGACGATCTCGATA<br>ATCTACTGGCTCAGATCGGGGACCAGTACGCTGACCTGTTTCTAGCTGCCAAGAACCTCAGTGACGCCAT<br>TCTCCTGTCCGATATTCTGAGGGTTAACACTGAAATTACAAAGGCCCCGCTGAGCGCGAGCATGATCAA<br>AAGGTACGACGAGCATCACCAGGACCTCACGCTGCTGAAGGCCTTAGTCAGACAGCAACTGCCCGAAA<br>AGTACAAAGAAATCTTTTTCGACCAATCCAAGAACGGGTACGCTGGCTACATTGATGGCGGGCTTCAC<br>AAGAGGAGTTTTACAAGTTTATCAAGCCCATCCTGGAGAAAATGGACGGCACTGAAGAACTGCTTGTGA<br>AACTCAATAGGGAAGACTTACTGAGGAAACAGCGCACATTCGATAATGGCTCCATACCCCACCAAATCC<br>ATCTGGGAGAGTTGCATGCCATCTTGCGAAGGCAGGAGGACTTCTACCCCTTTCTTAAGGACAACAGGG<br>AGAAAATCGAGAAATTCTGACTTTCCGTATCCCCTACTACGTGGGCCCACTTGCTCGCGGAAACTCACG<br>ATTCGCATGGATGACCAGAAAGTCCGAGGAAACAATTACACCCTGGAATTTTGAGGAGGTAGTAGACAA<br>GGGAGCCAGCGCTCAATCTTTCATTGAGAGGATGACGAATTTGACAAGAACCTTCCAAACGAGAAGT<br>GCTTCCTAAGCACAGCCTGCTGTATGAGTATTTCACGGTGTACAACGAACTTACGAAGGTCAAGTATGTG<br>ACAGAGGGTATGCGGAAACCTGCTTTTCTGTCTGGTGAACAGAAGAAAGCTATCGTCGATCTCCTGTTTA<br>AAACCAACCGAAAGGTGACGGTGAAACAGTTGAAGGAGGATTACTTCAAGAAGATCGAGTGTTTTGATT |

TABLE 5-continued

| SEQ ID NO | Sequence |
|---|---|
| | CTGTTGAAATTTCTGGGGTCGAGGATAGATTCAACGCCAGCCTGGGCACCTACCATGATTTGCTGAAGAT<br>TATCAAGGATAAGGATTTTCTGGATAATGAGGAGAATGAAGACATTTTGGAGGATATAGTGCTGACCCT<br>CACCCTGTTCGAGGACCGGGAGATGATCGAGGAGAGACTGAAAACATACGCTCACCTGTTTGACGACAA<br>GGTCATGAAGCAGCTTAAGAGACGCCGTTACACAGGCTGGGGAAGATTATCCCGCAAATTAATCAACGG<br>GATACGCGATAAACAAAGTGGCAAGACCATACTCGACTTCCTAAAGAGCGATGGATTCGCAAATCGCAA<br>TTTCATGCAGTTGATCCACGACGATAGCCTGACCTTCAAAGAGGACATTCAGAAAGCGCAGGTGAGTGG<br>TCAAGGGGATTCCCTGCACGAACACATTGCTAACTTGGCTGGATCACCAGCCATTAAGAAAGGCATACT<br>GCAGACCGTTAAAGTGGTAGATGAGCTTGTGAAAGTCATGGGAAGACATAAGCCAGAGAACATAGTGA<br>TCGAAATGGCCAGGGAAAATCAGACCACGCAAAAGGGGCAGAAGAACTCAAGAGAGCGTATGAAGAG<br>GATCGAGGAGGGCATCAAGGAGCTGGGTAGCCAGATCCTTAAAGAGCACCCAGTTGAGAATACCCAGC<br>TGCAGAATGAGAAACTTTATCTCTATTATCTCCAGAACGGAAGGGATATGTATGTCGACCAGGAACTGG<br>ACATCAATCGGCTGAGTGATTATGACGTCGACCACATTGTGCCTCAAAGCTTTCTGAAGGATGATTCCAT<br>CGACAATAAAGTTCTGACCCGGTCTGATAAAAATAGAGGCAAATCCGACAACGTACCTAGCGAAGAAG<br>TCGTCAAAAAAATGAAGAACTATTGGAGGCAGTTGCTGAATGCCAAGCTGATTACACAACGCAAGTTTG<br>ACAATCTCACCAAGGCAGAAAGGGGGGGCCTGTCAGAACTCGACAAAGCAGGTTTCATTAAAAGGCAG<br>CTAGTTGAAACTAGGCAGATTACTAAGCACGTGGCCCAGATCCTCGACTCACGGATGAATACAAAGTAT<br>GATGAGAATGATAAGCTAATCCGGGAGGTGAAGGTGATTACTCTGAAATCTAAGCTGGTGTCAGATTTC<br>AGAAAAGACTTCCAGTTCTACAAAGTCAGAGAGATCAACAATTATCACCATGCCCACGATGCATATCTT<br>AATGCAGTAGTGGGGACAGCTCTGATCAAAAATATCCTAAACTGGAGTCTGAATTCGTTTATGGTGAC<br>TATAAAGTCTATGACGTCAGAAAATGATCGCAAAGAGCGAGCAGGAGATAGGGAAGGCCACAGCAAA<br>GTACTTCTTTTACAGTAATATCATGAACTTTTTCAAAACTGGAGTCTAACGGCGAGATCCGC<br>AAGCGGCCACTGATAGAGACTAACGGAGAGACAGGGGAGATTGTTTGGGATAAGGGCCGTGACTTCGC<br>CACCGTTAGGAAAGTGCTGTCCATGCCCCAGGTGAACATTGTGAAGAAGACAGAAGTGCAGACGGGTG<br>GGTTCTCAAAAGAGTCTATTCTGCCTAAGCGGAATAGTGACAAACTGATCGCACGTAAAAAGGACTGGG<br>ATCCAAAAAAGTACGGCGGATTCGACAGTCCTACCGTTGCATATTCCGTGCTTGTGGTCGCTAAGGTGG<br>AGAAGGGAAAAGCAAGAAACTGAAGTCAGTCAAAGAACTACTGGGCATAACGATCATGGAGCGCTCC<br>AGTTTCGAAAAAAACCCAATCGATTTTCTTGAAGCCAAGGGATACAAGGAGGTAAAGAAAGACCTTATC<br>ATTAAGCTGCCTAAGTACAGTCTGTTCGAACTGGAGAATGGGAGGAAGCGCATGCTGGCATCAGCTGGA<br>GAACTCCAAAAAGGGAACGAGTTGGCCCTCCCCTCAAAGTATGTCAATTTTTCTCTACCTGGCTTCTCACT<br>ACGAGAAGTTAAAGGGGTCTCCAGAGGATAATGAGCAGAAACAGCTGTTTGTGGAACAGCACAAGCAC<br>TATTTGGACGAAATCATCGAACAAATTTCCGAGTTCAGTAAGAGGGTGATTCTGGCCGACGCAAACCTT<br>GACAAAGTTCTGTCCGCATACAATAAGCACAGAGACAAACCAATCCGCGAGCAAGCCGAGAATATAAT<br>TCACCTTTTCACTCTGACTAATCTGGGGCCCCCGCAGCATTTAAATATTTCGATACAACAATCGACCGG<br>AAGCGGTATACATCTACTAAGGAAGTCCTCGATGCGACACTGATCCACCAGTCAATTACAGGTTTATAT<br>GAAACAAGAATCGACCTGTCCCAGCTGGGCGGCGACTAG |
| SEQ ID NO: 171 | AAAATTCcatGCAAAATGCTCCGGTTTCATGTCATCAAAATGATGACGTAATTAAGCATTGATAATTGAGATCCCTCTCCCTGACAGGATGATTACATA<br>AATAATAGTGACAAAAATAAATTATTTATTTATCCAGAAAATGAATTGGAAAATCAGGAGAGCGTTTTCAATCCTACCTCTGGCGCAGTTGATATGTca<br>aaCAGGTtgccgtcactgcgtctttttactggctcttctcgctaaccaaaccggtaaccccgcttattaaaagcattctgtaacaaagcgggaccaaagc<br>catgacaaaaacgcgtaacaaaagtgtctataatcacggcagaaaagtccacattgattatttgcacggcgtcacactttgctatgccatagcattttt<br>atccataagattagcggatcctacctgacgctttttatcgcaactctctactgtttctccatacccgttttttttgggctagcaccgcctatctcgtgtg<br>agataggcggagatacgaacttttaagAAGGAGatataccATGGAACAGGAATATTATCTGGGCTTGGACATGGGCACCGGTTCCGTCGGCTGGGCTGTT<br>ACTGACAGTGAATATCACGTTCTAAGAAAGCATGGTAAGGCATTGTGGGTGTAAGACTTTTCGAATCTGCTTCCACTGCTGAAGAGCGTAGAATGTTT<br>AGAACGAGTCGACGTAGGCTAGACAGGCGCAATTGGAGAATCGAAATTTTACAAGAAATTTTTGCGGAAGAGATATCTAAGAAAGACCCAGGCTTTTTC<br>CTGAGAATGAAGGAATCTAAGTATTACCCTGAGGATAAAAGAGATATAAATGGTAACTGTCCCGAATTGCCTTACGCATTATTTGTGGACGATGATTTT<br>ACCGATAAGGATTACCATAAAAGTTCCCAACTATCTACCATTTACCGCAAAATGTTAATGAATACAGAGGAAAACCCAGACATAAGACTAGTTTATCTG<br>GCAATACACCCATATGATGAAACATAGAGGCCATTTCTTACTTTCCGGGGATATCAACGAAATCAAAGAGTTTGGTACCACATTTAGTAAGTTACTGGAA<br>AACATAAAGAATGAAGAATTGGATTGGAACTTAGAACTCGGAAAAGAAGAATACGCGGTTGTCGAATCTATCCTGAAGGATAATATGCTGAATAGGTCG<br>ACCAAAAAAACTAGGCTGATCAAAGCACTGAAAGCCAAATCTATCTGCGAAAAAGCTGTTTTAAATTTACTTGCTGGTGGCACTGTTAAGTTATCAGAC<br>ATTTTTGGTTTGGAAGAATTGAACGAAACCGAGCGTCCAAAAATTAGTTCGCTGATAATGGCTACGATGATTACATTGGTGAGGTGGAAAACGAGTTG<br>GGCGAACAATTTTATATTATAGAGACAGCTAAGGCAGTCTATGACTGGGCTGTTTTAGTAGAAAATCCTTGGTAAATACACATCTATCTCCAAGCGAAA<br>GTTGCTACTTACGAAAAGCACAAGTCCGATCTCCAGTTTTTGAAGAAAATTGTCAGGAAATATCTGACTAAGGAAGAATATAAAGATATTTCGTTAGT<br>ACCTCTGACAAACTGAAAATTACTCCGCTTACATCGGGATGACCAAGATTAATGGCAAAAAGTTGATCTGCAAAGCAAAGGTGTTCGAAGGAAGAA<br>TTTTATGATTTCATTAAAAAGAATGTCTTAAAAAAATTAGAAGGTCAGCCAGAATAATCGAATATTTGAAAGAAGAACTGGAAAGAGAGCATTCTTACCA<br>AAACAAGTCAACAGAGATAATGGGGTAATTCCATATCAAATTCACCTCTACGAATTAAAAAAAATTTTAGGCAATTTACGCGATAAAATTGACCTTATC<br>AAAGAAATGAGGATAAGCTGGTTCAACTCTTTGAATTCAGAATACCCTATTATGTGGGCCCACTGAACAAGATTGATGACGGCAAAGAAGGTAAATTC<br>ACATGGGCCGTCCGCAAATCCAATGAAAAATTTACCCATGGAACTTTGAAAATGTAGTAGATATTGAAGCGTCTGCGGAGAAATTTATTCGAAGAATG<br>ACTAATAAATGCACTTACTTGATGGGAGAGGATGTTCTGCCTAAAGACACGCTTATTATACAGCAAGTACATGGTTCTAAACGAACTTAACAACGTTAAG<br>TTGGACGGTGAGAATTAAGTGTGAATTGAAACAAAGATTGTATACTGACGTCTTCTGCAAGTACAGAAAGTGACAGTTAAAAAAATTAAGAATTAC<br>TTGAAGTGCGAAGGTATAATTTCTGGAAACGTAGAGATTACTGGTATTGATGGTGATTTCAAAGCATCCCTAACAGCTTACCACGATTTCAAGGAAATC<br>CTGACAGGAACTGAACTCGCAAAAAAGATAAAGAAAACATTATTACTAATATTGTTCTTTTCGGTGATGACAAGAAATTGTTGAAGAAAAGACTGAAT<br>AGACTTTACCCCCAGATTACTCCCAATCAACTTAAGAAAATTTGTGCTTTGTCTTACACAGGATGGGGTCGTTTTTCAAAAAAGTTCTTAGAAGAGATT<br>ACCGCACCTGATCCAGAAACAGGCGAGATTGTCTTAAAAAAATTAGAAGGTCAGCCAGAATATAATTACCGCCTATGGGGAATCGAACAATAATCTTATGCAACTTCTGAGCAATGAATATCGT<br>TTCATGGAAGAAGTTGAGACTTACAACATGGGCAAACAGACGAAGACTTTATCCTATGAAACTGTGGAAAATATGTATGTATCACCTTCTGTCAAGAGA<br>CAAATTTGGCAAACCTTAAAATTGTCAAAGAATTAGAAAAGGTAATGAAGGAGTCTCCTAAACGTGTGTTTATTGAAATGGCTAGAGAAAAACAAGAG<br>TCAAAAAGAACCGAGTCAAGAAGAAGCAGTTAATCGATTTATATAAGGCTTGTAAAAACGAAGAGAAAGATTGGGTTAAAGAATTGGGGGACCAAGAG<br>GAACAAAAACTACGGTCGGATAAGTTGTATTTATACTATACGCAAAAGGGACGATGTATGTATTCCGGCGAGGTAATAGAATTGAAGGATTTATGGAC<br>AATACAAAAATGACATAGACCATATATATCCCCAATCAAAACGATGGACATAGCTTGAACAATAGAGTACTCGTGAAAAAAATATAATGCGACC<br>AAATCTGATAAGTATCCTCTGAATGAAAATATCAGACATGAAAGAAAGGGTTCTGGAAGTCCTTGTTAGATGGTGGGTTTATAAGCAAAGAAAAGTAC<br>GAGCGTCTAATAAGAAAACACGGAGTTATCGCCAGAAGAACTCGCTGGTTTTATTGAGAGGCAAATCGTGGAAACGAGACAATCTACCAAAGCCGTTGCT<br>GAGATCCTAAAGCAAGTTTTCCCAGAGTCGGAGATTGTCTATGTCAAAGCTGGCACAGTGACCAGTTGAATATTCGTGTAGGTAACTCATATTATGTTAAATTTACCAAGAACGCCTCTTGGTTTATA<br>AAGGAGAACCCAGGCTAGAACATATAACCTGAAAAGATGTTCACCTCTGGTTGGAATATTGAGAGAAACGGAGAAGTCGCATGGGAAGTTGGTAAGAAA<br>GGGACTATAGTGACAGTAAAGCAAATTATGAACAAAATAATATCCTCGTTACAAGGCAGGTTCATGAAGCAAAGGGCGGCCTTTTTGACCAACAAATT<br>ATGAAGAAAGGGAAAGGTCAAATTGCAATAAAAGAAACCGATGAGAGACTAGCGTCAATAGAAAAGTATGGTGGCTATAATAAAGCTGCGGGTCATAC<br>TTTATGCTTGTTGAATCAAAAGACAAGAAAGGTAAGACTATTAGAACTATAGAATTTATACCCCTGTACCTTAAAAACAAAATTGAATCGGATGAGTCA |

TABLE 5-continued

| SEQ ID NO | Sequence |
|---|---|
| | ATCGCGTTAAATTTTCTAGAGAAAGGAAGGGGTTTAAAAGAACCAAAGATCCTGTTAAAAAAGATTAAGATTGACACCTTGTTCGATGTAGATGGATTT AAAATGTGGTTATCTGGCAGAACAGGCGATAGACTTTTGTTTAAGTGCGCTAATCAATTAATTTTGGATGAGAAAATCATTGTCACAATGAAAAAATA GTTAAGTTTATTCAGAGAAGACAAGAAAACAGGGAGTTGAAATTATCTGATAAAGATGGTATCGACAATGAAGTTTTAATGGAAATCTACAATACATTC GTTGATAAACTTGAAAATACCGTATATCGAATCAGGTTAAGTGAACAAGCCAAAACATTAATTGATAAACAAAAAGAATTTGAAAGGCTATCACTGGAA GACAAATCCTCCACCCTATTTGAAATTTTGCATATATTCCAGTGCCAATCTTCAGCAGCTAATTTAAAAATGATTGGCGGACCTGGGAAAGCCGGCATC CTAGTGATGAACAATAATATCTCCAAGTGTAACAAAATATCAATTATTAACCAATCTCCGACAGGTATTTTTGAAAATGAAATAGACTTGCTTAAGATA TAAGAAATCATCCTTAGCGAAAGCTAAGGATTTTTTTTATCTGAAATTTATTATATCGCGTTGATTATTGATGCTGTTTTTAGTTTTAACGGCAATTAA TATATGTGTTATTAATTGAATGAATTTTATCATTCATAATAAGTATGTGTAGGATCAAGCTCAGGTTAAATATTCACTCAGGAAGTTATTACTCAGGAA GCAAAGAGGATTACAGAATTATCTCATAACAAGTGTTAAGGGATGTTATTTCC |
| SEQ ID NO: 172 | AATTCAAAGGATAATCAAAC |
| SEQ ID NO: 173 | AATCTCTACTCTTTGTAGAT |
| SEQ ID NO: 174 | AATTTCTACTGTTGTAGAT |
| SEQ ID NO: 175 | AATTTCTACTAGTGTAGAT |
| SEQ ID NO: 176 | AATTTCTACTATTGT |
| SEQ ID NO: 177 | AATTTCTACTGTTGTAGA |
| SEQ ID NO: 178 | AATTTCTACTATTGTA |
| SEQ ID NO: 179 | AATTTCTACTTTTGTAGAT |
| SEQ ID NO: 180 | AATTTCTACTGTTGTAGAT |
| SEQ ID NO: 181 | AATTTCTACTCTTGTAGAT |

SEQUENCE LISTING (211 sequences)

SEQ ID NO: 1 - protein, 1358 aa, Artificial Sequence
  Description of Artificial Sequence: Synthetic polypeptide
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 2 - protein, 1334 aa, Artificial Sequence
  Description of Artificial Sequence: Synthetic polypeptide
MSSLTKFTNKYSKQLTIKNELIPVGKTLENIKENGLIDGDEQLNENYQKAKIIVDDFLRDFINKALNNTQIGNWRELADALNKEDEDNIEKLQDKIRGIIVSKFETFDLFSSYSIKKDEKIIDDDNDVEEEELDLGKKTSSFKYIFKKNLFKLVLPSYLKTTNQDKLKIISSFDNFSTYFRGFFENRKNIFTKKPISTSIAYRIVHDNFPKFLDNIRCFNVWQTECPQLIVKADNYLKSKNVIAKDKSLANYFTVGAYDYFLSQNGIDFYNNIIGGLPAFAGHEKIQGLNEFINQECQKDSELKSKLKNRHAFKMAVLFKQILSDREKSFVIDEFESDAQVIDAVKNFYAEQCKDNNVIFNLLNLIKNIAFLSDDELDGIFIEGKYLSSVSQKLYSDWSKLRNDIEDSANSKQGNKELAKKIKTNKGDVEKAISKYEFSLSELNSIVHDNTKFSDLLSCTLHKVASEKLVKVNEGDWPKHLKNNEEKQKIKEPLDALLEIYNTLLIFNCKSFNKNGNFYVDYDRCINELSSVVYLYNKTRNYCTKKPYNTDKFKLNFNSPQLGEGFSKSKENDCLTLLFKKDDNYYVGIIRKGAKINFDDTQAIADNTDNCIFKMNYFLLKDAKKFIPKCSIQLKEVKAHFKKSEDDYILSDKEKFASPLVIKKSTFLLATAHVKGKKGNIKKFQKEYSKENPTEYRNSLNEWIAFCKEFLKTYKAATIFDITTLKKAEEYADIVEFYKDVDNLCYKLEFCPIKTSFIENLIDNGDLYLFRINNKDFSSKSTGTKNLHTLYLQAIFDERNLNNPTIMLNGGAELFYRKESIEQKNRITHKAGSILVNKVCKDGTSLDDKIRNEIYQYENKFIDTLSDEAKKVLPNVIKKEATHDITKDKRFTSDKFFFHCPLTINYKEGDTKQFNNEVLSFLRGNPDINIIGIDRGERNLIYVTVINQKGEILDSVSFNTVTNKSSKIEQTVDYEEKLAVREKERIEAKRSWDSISKIATLKEGYLSAIVHEICLLMIKHNAIVVLENLNAGFKRIRGGLSEKSVYQKFEKMLINKLNYFVSKKESDWNKPSGLLNGLQLSDQFESFEKLGIQSGFIFYVPAAYTSKIDPTTGFANVLNLSKVRNVDAIKSFFSNFNEISYSKKEALFKFSFDLDSLSKKGFSSFVKFSKSKWNVYTFGERIIKPKNKQGYREDKRINLTFEMKKLLNEYKVSFDLENNLIPNLTSANLKDTFWKELFFIFKTTLQLRNSVTNGKEDVLISPVKNAKGEFFVSGTHNKTLPQDCDANGAYHIALKGLMILERNNLVREEKDTKKIMAISNVDWFEYVQKRRGVL

SEQ ID NO: 3 - protein, 1238 aa, Artificial Sequence
  Description of Artificial Sequence: Synthetic polypeptide
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 4 - protein, 1298 aa, Artificial Sequence
  Description of Artificial Sequence: Synthetic polypeptide
MTKTFDSEFFNLYSLQKTVRFELKPVGETASFVEDFKNEGLKRVVSEDERRAVDYQKVKEIIDDYHRDFIEESLNYFPEQVSKDALEQAFHLYQKLKAAKVEEREKALKEWEALQKKLREKVVKCFSDSNKARFSRIDKKELIKEDLINWLVAQNREDDIPTVETFNNFTTYFTGFHENRKNIYSKDDHATAISFRLIHENLPKFFDNVISFNKLKEGFPELKFDKVKEDLEVDYDLKHAFEIEYFVNFVTQAGIDQYNYLLGGKTLEDGTKKQGMNEQINLFKQQQTRDKARQIPKLIPLFKQILSERTESQSFIPKQFESDQELFDSLQKLHNNCQDKFTVLQQAILGLAEADLKKVFIKTSDLNALSNTIFGNYSVFSDALNLYKESLKTKKAQEAFEKLPAHSIHDLIQYLEQFNSSLDAEKQQSTDTVLNYFIKTDELYSRFIKSTSEAFTQVQPLFELEALSSKRRPPESEDEGAKGQEGFEQIKRIKAYLDTLMEAVHFAKPLYLVKGRKMIEGLDKDQSFYEAFEMAYQELESLIIPIYNKARSYLSRKPFKADKFKINFDNNTLLSGWDANKETANASILFKKDGLYYLGIMPKGKTFLFDYFVSSEDSEKLKQRRQKTAEEALAQDGESYFEKIRYKLLPGASKMLPKVFFSNKNIGFYNPSDDILRIRNTASHTKNGTPQKGHSKVEFNLNDCHKMIDFFKSSIQKHPEWGSFGFTFSDTSDFEDMSAFYREVENQGYVISFDKIKETYIQSQVEQGNLYLFQIYNKDFSPYSKGKPNLHTLYWKALFEEANLNNVVAKLNGEAEIFFRRHSIKASDKVVHPANQAIDNKNPHTEKTQSTFEYDLVKDKRYTQDKFFFHVPISLNFKAQGVSKFNDKVNGFLKGNPDVNIIGIDRGERHLLYFTVVNQKGEILVQESLNTLMSDKGHVNDYQQKLDKKEQERDAARKSWTTVENIKELKEGYLSHVVHKLAHLIIKYNAIVCLEDLNFGFKRGRFKVEKQVYQKFEKALIDKLNYLVFKEKELGEVGHYLTAYQLTAPFESFKKLGKQSGILFYVPADYTSKIDPTTGFVNFLDLRYQSVEKAKQLLSDFNAIRFNSVQNYFEFEIDYKKLTPKRKVGTQSKWVICTYGDVRYQNRRNQKGHWETEEVNVTEKLKALFASDSKTTTVIDYANDDNLIDVILEQDKASFFKELLWLLKLTMTLRHSKIKSEDDFILSPVKNEQGEFYDSRKAGEVWPKDADANGAYHIALKGLWNLQQINQWEKGKTLNLAIKNQDWFSFIQEKPYQE

SEQ ID NO: 5 - protein, 1235 aa, Artificial Sequence
  Description of Artificial Sequence: Synthetic polypeptide
MHTGGLLSMDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNKERDNKAAILRKDGKYYLAILDMKKDLSSIRTSDEDESSFEKMEYKLLPSPVKMLPKIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 6 - protein, 1260 aa, Artificial Sequence
  Description of Artificial Sequence: Synthetic polypeptide
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKVLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRHYTMDKFQFHVPITMNFKCSAGSKVNDMVNAHIREAKDMHVIGIDRGERNLLYICVIDSRGTILDQISLNTINDIDYHDLLESRDKDRQQERRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHAQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 7 - protein, 1263 aa, Artificial Sequence
  Description of Artificial Sequence: Synthetic polypeptide
MNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 8 - protein, 1318 aa, Artificial Sequence
  Description of Artificial Sequence: Synthetic polypeptide
MTNKFTNQYSLSKTLRFELIPQGKTLEFIQEKGLLSQDKQRAESYQEMKKTIDKFHKYFIDLALSNAKLTHLETYLELYNKSAETKKEQKFKDDLKKVQDNLRKEIVKSFSDGDAKSIFAILDKKELITVELEKWFENNEQKDIYFDEKFKTFTTYFTGFHQNRKNMYSVEPNSTAIAYRLIHENLPKFLENAKAFEKIKQVESLQVNFRELMGEFGDEGLIFVNELEEMFQINYYNDVLSQNGITIYNSIISGFTKNDIKYKGLNEYINNYNQTKDKKDRLPKLKQLYKQILSDRISLSFLPDAFTDGKQVLKAIFDFYKINLLSYTIEGQEESQNLLLLIRQTIENLSSFDTQKIYLKNDTHLTTISQQVFGDFSVFSTALNYWYETKVNPKFETEYSKANEKKREILDKAKAVFTKQDYFSIAFLQEVLSEYILTLDHTSDIVKKHSSNCIADYFKNHFVAKKENETDKTFDFIANITAKYQCIQGILENADQYEDELKQDQKLIDNLKFFLDAILELLHFIKPLHLKSESITEKDTAFYDVFENYYEALSLLTPLYNMVRNYVTQKPYSTEKIKLNFENAQLLNGWDANKEGDYLTTILKKDGNYFLAIMDKKHNKAFQKFPEGKENYEKMVYKLLPGVNKMLPKVFFSNKNIAYFNPSKELLENYKKETHKKGDTFNLEHCHTLIDFFKDSLNKHEDWKYFDFQFSETKSYQDLSGFYREVEHQGYKINFKNIDSEYIDGLVNEGKLFLFQIYSKDFSPFSKGKPNMHTLYWKALFEEQNLQNVIYKLNGQAEIFFRKASIKPKNIILHKKKIKIAKKHFIDKKTKTSEIVPVQTIKNLNMYYQGKISEKELTQDDLRYIDNFSIFNEKNKTIDIIKDKRFTVDKFQFHVPITMNFKATGGSYINQTVLEYLQNNPEVKIIGLDRGERHLVYLTLIDQQGNILKQESLNTITDSKISTPYHKLLDNKENERDLARKNWGTVENIKELKEGYISQVVHKIATLMLEENAIVVMEDLNFGFKRGRFKVEKQIYQKLEKMLIDKLNYLVLKDKQPQELGGLYNALQLTNKFESFQKMGKQSGFLFYVPAWNTSKIDPTTGFVNYFYTKYENVDKAKAFFEKFEAIRFNAEKKYFEFEVKKYSDFNPKAEGTQQAWTICTYGERIETKRQKDQNNKFVSTPINLTEKIEDFLGKNQIVYGDGNCIKSQIASKDDKAFFETLLYWFKMTLQMRNSETRTDIDYLISPVMNDNGTFYNSRDYEKLENPTLPKDADANGAYHIAKKGLMLLNKIDQADLTKKVDLSISNRDWLQFVQKNK

SEQ ID NO: 9 - protein, 1339 aa, Artificial Sequence
  Description of Artificial Sequence: Synthetic polypeptide
MEQEYYLGLDMGTGSVGWAVTDSEYHVLRKHGKALWGVRLFESASTAEERRMFRTSRRRLDRRNWRIEILQEIFAEEISKKDPGFFLRMKESKYYPEDKRDINGNCPELPYALFVDDDFTDKDYHKKFPTIYHLRKMLMNTEETPDIRLVYLAIHHMMKHRGHFLLSGDINEIKEFGTTFSKLLENIKNEELDWNLELGKEEYAVVESILKDNMLNRSTKKTRLIKALKAKSICEKAVLNLLAGGTVKLSDIFGLEELNETERPKISFADNGYDDYIGEVENELGEQFYIIETAKAVYDWAVLVEILGKYTSISEAKVATYEKHKSDLQFLKKIVRKYLTKEEYKDIFVSTSDKLKNYSAYIGMTKINGKKVDLQSKRCSKEEFYDFIKKNVLKKLEGQPEYEYLKEELERETFLPKQVNRDNGVIPYQIHLYELKKILGNLRDKIDLIKENEDKLVQLFEFRIPYYVGPLNKIDDGKEGKFTWAVRKSNEKIYPWNFENVVDIEASAEKFIRRMTNKCTYLMGEDVLPKDSLLYSKYMVLNELNNVKLDGEKLSVELKQRLYTDVFCKYRKVTVKKIKNYLKCEGIISGNVEITGIDGDFKASLTAYHDFKEILTGTELAKKDKENIITNIVLFGDDKKLLKKRLNRLYPQITPNQLKKICALSYTGWGRFSKKFLEEITAPDPETGEVWNIITALWESNNNLMQLLSNEYRFMEEVETYNMGKQTKTLSYETVENMYVSPSVKRQIWQTLKIVKELEKVMKESPKRVFIEMAREKQESKRTESRKKQLIDLYKACKNEEKDWVKELGDQEEQKLRSDKLYLYYTQKGRCMYSGEVIELKDLWDNTKYDIDHIYPQSKTMDDSLNNRVLVKKKYNATKSDKYPLNENIRHERKGFWKSLLDGGFISKEKYERLIRNTELSPEELAGFIERQIVETRQSTKAVAEILKQVFPESEIVYVKAGTVSRFRKDFELLKVREVNDLHHAKDAYLNIVVGNSYYVKFTKNASWFIKENPGRTYNLKKMFTSGWNIERNGEVAWEVGKKGTIVTVKQIMNKNNILVTRQVHEAKGGLFDQQIMKKGKGQIAIKETDERLASIEKYGGYNKAAGAYFMLVESKDKKGKTIRTIEFIPLYLKNKIESDESIALNFLEKGRGLKEPKILLKKIKIDTLFDVDGFKMWLSGRTGDRLLFKCANQLILDEKIIVTMKKIVKFIQRRQENRELKLSDKDGIDNEVLMEIYNTFVDKLENTVYRIRLSEQAKTLIDKQKEFERLSLEDKSSTLFEILHIFQCQSSAANLKMIGGPGKAGILVMNNNISKCNKISIINQSPTGIFENEIDLLK

SEQ ID NO: 10 - protein, 1280 aa, Artificial Sequence
  Description of Artificial Sequence: Synthetic polypeptide
MNKFENFTGLYPISKTLRFELIPQGKTLEYIEKSEILENDNYRAEKYEEVKDIIDGYHKWFINETLHDLHINWSELKVALENNRIEKSDASKKELQRVQKIKREEIYNAFIEHEAFQYLFKENLLSDLLPIQIEQSEDLDAEKKKQAVETFNRFSTYFTGFHENRKNIYSKEGISTSVTYRIVHDNFPKFLENMKVFEILRNECPEVISDTANELAPFIDGVRIEDIFLIDFFNSTFSQNGIDYYNRILGGVTTETGEKYRGINEFTNLYRQQHPEFGKSKKATKMVVLFKQILSDRDTLSFIPEMFGNDKQVQNSIQLFYNREISQFENEGVKTDVCTALATLTSKIAEFDTEKIYIQQPELPNVSQRLFGSWNELNACLFKYAELKFGTAEKVANRKKIDKWLKSDLFSFTELNKALEFSGKDERIENYFSETGIFAQLVKTGFDEAQSILETEYTSEVHLKDQQTDIEKIKTFLDALQNLMHLLKSLCVSEEADRDAAFYNEFDMLYNQLKLVVPLYNKVRNYITQKLFRSDKIKIYFENKGQFLGGWVDSQTENSDNGTQAGGYIFRKENVINEYDYYLGICSDPKLFRRTTIVSENDRSSFERLDYYQLKTASVYGNSYCGKHPYTEDKNELVNSIDRFVHLSGNNILIEKIAKDKVKSNPTTNTPSGYLNFIHREAPNTYECLLQDENFVSLNQRVVSALKATLATLVRVPKALVYAKKDYHLFSEIINDIDELSYEKAFSYFPVSQTEFENSSNRTIKPLLLFKISNKDLSFAENFEKGNRQKIGKKNLHTLYFEALMKGNQDTIDIGTGMVFHRVKSLNYNEKTLKYGHHSTQLNEKFSYPIIKDKRFASDKFLFHLSTEINYKEKRKPLNNSIIEFLTNNPDINIIGLDRGERHLIYLTLINQKGEILRQKTFNIVGNTNYHEKLNQREKERDNARKSWATIGKIKELKEGFLSLVIHEIAKIMVENNAIVVLEDLNFGFKRGRFKVEKQIYQKFEKMLIDKLNYLVFKDKKANEAGGVLKGYQLAEKFESFQKMGKQSGFLFYVPAAYTSKIDPTTGFVNMLNLNYTNMKDAQTLLSGMDKISFNADANYFEFELDYEKFKTNQTDHTNKWTICTVGEKRFTYNSATKETTTVNVTEDLKKLLDKFEVKYSNGDNIKDEICRQTDAKFFEIILWLLKLTMQMRNSNTKTEEDFILSPVKNSNGEFFRSNDDANGIWPADADANGAYHIALKGLYLVKECFNKNEKSLKIEHKNWFKFAQTRFNGSLTKNG

SEQ ID NO: 11 - protein, 1154 aa, Artificial Sequence
  Description of Artificial Sequence: Synthetic polypeptide
MENFKNLYPINKTLRFELRPYGKTLENFKKSGLLEKDAFKANSRRSMQAIIDEKFKETIEERLKYTEFSECDLGNMTSKDKKITDKAATNLKKQVILSFDDEIFNNYLKPDKNIDALFKNDPSNPVISTFKGFTTYFVNFFEIRKHIFKGESSGSMAYRIIDENLTTYLNNIEKIKKLPEELKSQLEGIDQIDKLNNYNEFITQSGITHYNEIIGGISKSENVKIQGINEGINLYCQKNKVKLPRLTPLYKMILSDRVSNSFVLDTIENDTELIEMISDLINKTEISQDVIMSDIQNIFIKYKQLGNLPGISYSSIVNAICSDYDNNFGDGKRKKSYENDRKKHLETNVYSINYISELLTDTDVSSNIKMRYKELEQNYQVCKENFNATNWMNIKNIKQSEKTNLIKDLLDILKSIQRFYDLFDIVDEDKNPSAEFYTWLSKNAEKLDFEFNSVYNKSRNYLTRKQYSDKKIKLNFDSPTLAKGWDANKEIDNSTIIMRKFNNDRGDYDYFLGIWNKSTPANEKIIPLEDNGLFEKMQYKLYPDPSKMLPKQFLSKIWKAKHPTTPEFDKKYKEGRHKKGPDFEKEFLHELIDCFKHGLVNHDEKYQDVFGFNLRNTEDYNSYTEFLEDVERCNYNLSFNKIADTSNLINDGKLYVFQIWSKDFSIDSKGTKNLNTIYFESLFSEENMIEKMFKLSGEAEIFYRPASLNYCEDIIKKGHHHAELKDKFDYPIIKDKRYSQDKFFFHVPMVINYKSEKLNSKSLNNRTNENLGQFTHIIGIDRGERHLIYLTVVDVSTGEIVEQKHLDEIINTDTKGVEHKTHYLNKLEEKSKTRDNERKSWEAIETIKELKEGYISHVINEIQKLQEKYNALIVMENLNYGFKNSRIKVEKQVYQKFETALIKKFNYIIDKKDPETYIHGYQLTNPITTLDKIGNQSGIVLYIPAWNTSKIDPVTGFVNLLYADDLKYKNQEQAKSFIQKIDNIYFENGEFKFDIDFSKWNNRYSISKTKWTLTSYGTRIQTFRNPQKNNKWDSAEYDLTEEFKLILNIDGTLKSQDVETYKKFMSLFKLMLQLRNSVTGTDIDYMISPVTDKTGTHFDSRENIKNLPADADANGAYNIARKGIMAIENIMNGISDPLKISNEDYLKYIQNQQE

SEQ ID NO: 12 - protein, 1307 aa, Artificial Sequence
  Description of Artificial Sequence: Synthetic polypeptide
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 13 - protein, 1129 aa, Artificial Sequence
  Description of Artificial Sequence: Synthetic polypeptide
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 14 - protein, 1108 aa, Artificial Sequence
  Description of Artificial Sequence: Synthetic polypeptide
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 15 - protein, 1149 aa, Artificial Sequence
  Description of Artificial Sequence: Synthetic polypeptide
MPTRTINLKLVLGKNPENATLRRALFSTHRLVNQATKRIEEFLLLCRGEAYRTVDNEGKEAEIPRHAVQEEALAFAKAAQRHNGCISTYEDQEILDVLRQLYERLVPSVNENNEAGDAQAANAWVSPLMSAESEGGLSVYDKVLDPPPVWMKLKEEKAPGWEAASQIWIQSDEGQSLLNKPGSPPRWIRKLRSGQPWQDDFVSDQKKKQDELTKGNAPLIKQLKEMGLLPLVNPFFRHLLDPEGKGVSPWDRLAVRAAVAHFISWESWNHRTRAEYNSLKLRRDEFEAASDEFKDDFTLLRQYEAKRHSTLKSIALADDSNPYRIGVRSLRAWNRVREEWIDKGATEEQRVTILSKLQTQLRGKFGDPDLFNWLAQDRHVHLWSPRDSVTPLVRINAVDKVLRRRKPYALMTFAHPRFHPRWILYEAPGGSNLRQYALDCTENALHITLPLLVDDAHGTWIEKKIRVPLAPSGQIQDLTLEKLEKKKNRLYYRSGFQQFAGLAGGAEVLFHRPYMEHDERSEESLLERPGAVWFKLTLDVATQAPPNWLDGKGRVRTPPEVHHFKTALSNKSKHTRTLQPGLRVLSVDLGMRTFASCSVFELIEGKPETGRAFPVADERSMDSPNKLWAKHERSFKLTLPGETPSRKEEEERSIARAEIYALKRDIQRLKSLLRLGEEDNDNRRDALLEQFFKGWGEEDVVPGQAFPRSLFQGLGAAPFRSTPELWRQHCQTYYDKAEACLAKHISDWRKRTRPRPTSREMWYKTRSYHGGKSIWMLEYLDAVRKLLLSWSLRGRTYGAINRQDTARFGSLASRLLHHINSLKEDRIKTGADSIVQAARGYIPLPHGKGWEQRYEPCQLILFEDLARYRFRVDRPRRENSQLMQWNHRAIVAETTMQAELYGQIVENTAAGFSSRFHAATGAPGVRCRFLLERDFDNDLPKPYLLRELSWMLGNTKVESEEEKLRLLSEKIRPGSLVPWDGGEQFATLHPKRQTLCVIHADMNAAQNLQRRFFGRCGEAFRLVCQPHGDDVLRLASTPGARLLGALQQLENGQGAFELVRDMGSTSQMNRFVMKSLGKKKIKPLQDNNGDDELEDVLSVLPEEDDTGRITVFRDSSGIFFPCNVWIPAKQFWPAVRAMIWKVMASHSLG

SEQ ID NO: 16 - protein, 1252 aa, Artificial Sequence
  Description of Artificial Sequence: Synthetic polypeptide
MTKLRHRQKKLTHDWAGSKKREVLGSNGKLQNPLLMPVKKGQVTEFRKAFSAYARATKGEMTDGRKNMFTHSFEPFKTKPSLHQCELADKAYQSLHSYLPGSLAHFLLSAHALGFRIFSKSGEATAFQASSKIEAYESKLASELACVDLSIQNLTISTLFNALTTSVRGKGEETSADPLIARFYTLLTGKPLSRDTQGPERDLAEVISRKIASSFGTWKEMTANPLQSLQFFEEELHALDANVSLSPAFDVLIKMNDLQGDLKNRTIVFDPDAPVFEYNAEDPADIIIKLTARYAKEAVIKNQNVGNYVKNAITTTNANGLGWLLNKGLSLLPVSTDDELLEFIGVERSHPSCHALIELIAQLEAPELFEKNVFSDTRSEVQGMIDSAVSNHIARLSSSRNSLSMDSEELERLIKSFQIHTPHCSLFIGAQSLSQQLESLPEALQSGVNSADILLGSTQYMLTNSLVEESIATYQRTLNRINYLSGVAGQINGAIKRKAIDGEKIHLPAAWSELISLPFIGQPVIDVESDLAHLKNQYQTLSNEFDTLISALQKNFDLNFNKALLNRTQHFEAMCRSTKKNALSKPEIVSYRDLLARLTSCLYRGSLVLRRAGIEVLKKHKIFESNSELREHVHERKHFVFVSPLDRKAKKLLRLTDSRPDLLHVIDEILQHDNLENKDRESLWLVRSGYLLAGLPDQLSSSFINLPIITQKGDRRLIDLIQYDQINRDAFVMLVTSAFKSNLSGLQYRANKQSFVVTRTLSPYLGSKLVYVPKDKDWLVPSQMFEGRFADILQSDYMVWKDAGRLCVIDTAKHLSNIKKSVFSSEEVLAFLRELPHRTFIQTEVRGLGVNVDGIAFNNGDIPSLKTFSNCVQVKVSRTNTSLVQTLNRWFEGGKVSPPSIQFERAYYKKDDQIHEDAAKRKIRFQMPATELVHASDDAGWTPSYLLGIDPGEYGMGLSLVSINNGEVLDSGFIHINSLINFASKKSNHQTKVVPRQQYKSPYANYLEQSKDSAAGDIAHILDRLIYKLNALPVFEALSGNSQSAADQVWTKVLSFYTWGDNDAQNSIRKQHWFGASHWDIKGMLRQPPTEKKPKPYIAFPGSQVSSYGNSQRCSCCGRNPIEQLREMAKDTSIKELKIRNSEIQLFDGTIKLFNPDPSTVIERRRHNLGPSRIPVADRTFKNISPSSLEFKELITIVSRSIRHSPEFIAKKRGIGSEYFCAYSDCNSSLNSEANAAANVAQKFQKQLFFEL

SEQ ID NO: 17 - protein, 1287 aa, Artificial Sequence
  Description of Artificial Sequence: Synthetic polypeptide
MKRILNSLKVAALRLLFRGKGSELVKTVKYPLVSPVQGAVEELAEAIRHDNLHLFGQKEIVDLMEKDEGTQVYSVVDFWLDTLRLGMFFSPSANALKITLGKFNSDQVSPFRKVLEQSPFFLAGRLKVEPAERILSVEIRKIGKRENRVENYAADVETCFIGQLSSDEKQSIQKLANDIWDSKDHEEQRMLKADFFAIPLIKDPKAVTEEDPENETAGKQKPLELCVCLVPELYTRGFGSIADFLVQRLTLLRDKMSTDTAEDCLEYVGIEEEKGNGMNSLLGTFLKNLQGDGFEQIFQFMLGSYVGWQGKEDVLRERLDLLAEKVKRLPKPKFAGEWSGHRMFLHGQLKSWSSNFFRLFNETRELLESIKSDIQHATMLISYVEEKGGYHPQLLSQYRKLMEQLPALRTKVLDPEIEMTHMSEAVRSYIMIHKSVAGFLPDLLESLDRDKDREFLLSIFPRIPKIDKKTKEIVAWELPGEPEEGYLFTANNLFRNFLENPKHVPRFMAERIPEDWTRLRSAPVWFDGMVKQWQKVVNQLVESPGALYQFNESFLRQRLQAMLTVYKRDLQTEKFLKLLADVCRPLVDFFGLGGNDIIFKSCQDPRKQWQTVIPLSVPADVYTACEGLAIRLRETLGFEWKNLKGHEREDFLRLHQLLGNLLFWIRDAKLVVKLEDWMNNPCVQEYVEARKAIDLPLEIFGFEVPIFLNGYLFSELRQLELLLRRKSVMTSYSVKTTGSPNRLFQLVYLPLNPSDPEKKNSNNFQERLDTPTGLSRRFLDLTLDAFAGKLLTDPVTQELKTMAGFYDHLFGFKLPCKLAAMSNHPGSSSKMVVLAKPKKGVASNIGFEPIPDPAHPVFRVRSSWPELKYLEGLLYLPEDTPLTIELAETSVSCQSVSSVAFDLKNLTTILGRVGEFRVTADQPFKLTPIIPEKEESFIGKTYLGLDAGERSGVGFAIVTVDGDGYEVQRLGVHEDTQLMALQQVASKSLKEPVFQPLRKGTFRQQERIRKSLRGCYWNFYHALMIKYRAKVVHEESVGSSGLVGQWLRAFQKDLKKADVLPKKGGKNGVDKKKRESSAQDTLWGGAFSKKEEQQIAFEVQAAGSSQFCLKCGWWFQLGMREVNRVQESGVVLDWNRSIVTFLIESSGEKVYGFSPQQLEKGFRPDIETFKKMVRDFMRPPMFDRKGRPAAAYERFVLGRRHRRYRFDKVFEERFGRSALFICPRVGCGNFDHSSEQSAVVLALIGYIADKEGMSGKKLVYVRLAELMAEWKLKKLERSRVEEQSSAQ

SEQ ID NO: 18 - protein, 1192 aa, Artificial Sequence
  Description of Artificial Sequence: Synthetic polypeptide
MAESKQMQCRKCGASMKYEVIGLGKKSCRYMCPDCGNHTSARKIQNKKKRDKKYGSASKAQSQRIAVAGALYPDKKVQTIKTYKYPADLNGEVHDSGVAEKIAQAIQEDEIGLLGPSSEYACWIASQKQSEPYSVVDFWFDAVCAGGVFAYSGARLLSTVLQLSGEESVLRAALASSPFVDDINLAQAEKFLAVSRRTGQDKLGKRIGECFAEGRLEALGIKDRMREFVQAIDVAQTAGQRFAAKLKIFGISQMPEAKQWNNDSGLTVCILPDYYVPEENRADQLVVLLRRLREIAYCMGIEDEAGFEHLGIDPGALSNFSNGNPKRGFLGRLLNNDIIALANNMSAMTPYWEGRKGELIERLAWLKHRAEGLYLKEPHFGNSWADHRSRIFSRIAGWLSGCAGKLKIAKDQISGVRTDLFLLKRLLDAVPQSAPSPDFIASISALDRFLEAAESSQDPAEQVRALYAFHLNAPAVRSIANKAVQRSDSQEWLIKELDAVDHLEFNKAFPFFSDTGKKKKKGANSNGAPSEEEYTETESIQQPEDAEQEVNGQEGNGASKNQKKFQRIPRFFGEGSRSEYRILTEAPQYFDMFCNNMRAIFMQLESQPRKAPRDFKCFLQNRLQKLYKQTFLNARSNKCRALLESVLISWGEFYTYGANEKKFRLRHEASERSSDPDYVVQQALEIARRLFLFGFEWRDCSAGERVDLVEIHKKAISFLLAITQAEVSVGSYNWLGNSTVSRYLSVAGTDTLYGTQLEEFLNATVLSQMRGLAIRLSSQELKDGFDVQLESSCQDNLQHLLVYRASRDLAACKRATCPAELDPKILVLPVGAFIASVMKMIERGDEPLAGAYLRHRPHSFGWQIRVRGVAEVGMDQGTALAFQKPTESEPFKIKPFSAQYGPVLWLNSSSYSQSQYLDGFLSQPKNWSMRVLPQAGSVRVEQRVALIWNLQAGKMRLERSGARAFFMPVPFSFRPSGSGDEAVLAPNRYLGLFPHSGGIEYAVVDVLDSAGFKILERGTIAVNGFSQKRGERQEEAHREKQRRGISDIGRKKPVQAEVDAANELHRKYTDVATRLGCRIVVQWAPQPKPGTAPTAQTVYARAVRTEAPRSGNQEDHARMKSSWGYTWGTYWEKRKPEDILGISTQVYWTGGIGESCPAVAVALLGHIRATSTQTEWEKEEVVFGRLKKFFPS

SEQ ID NO: 19 - protein, 986 aa, Artificial Sequence
  Description of Artificial Sequence: Synthetic polypeptide
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 20 - protein, 973 aa, Artificial Sequence
  Description of Artificial Sequence: Synthetic polypeptide
MKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKP

SEQ ID NO: 21 - DNA, 4077 bp, Artificial Sequence
  Description of Artificial Sequence: Synthetic polynucleotide
atgggaaaaatgtattatcttggtctggatataggaacaaattctgttggatatgccgtaaccgacccatcgtaccatttgctcaaatttaaaggcgaaccgatgtggggtgcccacgtgtttgctgcggggaatcaatcagctgaacggagaagctttcgtacgagccgcagacgccttgaccgcaggcaacagcgtgtcaaactggttcaagaaatctttgctcccgtgattagtcccattgatccacgtttttttatcagacttcatgagagcgctttatggcgggatgatgtggctgaaacggataaacatattttctttaatgacccgacctatacggataaggaatattattctgactatccaaccatccatcatctcattgtggaccttatggaaagcagtgaaaagcatgacccgcggcttgtttatttggctgttgcctggctggttgctcatcgtggtcatttcctcaatgaagtggataaggataatattggggatgtcctgagttttgacgccttttatcctgagtttctggcatttctttccgataatggggtgtcaccttgggtatgtgagtcaaaagcactccaagcgaccctgctttcacgaaactccgtcaacgataagtataaagccttgaagtctctgatctttggcagccaaaagccggaggataattttgatgccaatatcagtgaagatggacttatccaacttttagcaggaaaaaaggtcaaggtcaataaactttttcctcaagaaagtaatgatgcttcctttacactcaatgataaggaagatgcaattgaggaaatcttaggaacgcttacaccggatgagtgtgaatggattgcgcatattaggaggctgtttgattgggccatcatgaaacatgctctcaaagatggcagaacaatctccgaatcgaaagtaaagctctatgaacagcatcaccatgacttgacacagctcaagtattttgtgaagacctatctagcaaaggaatatgatgacatttttcgaaacgtagatagtgaaacaaccaaaaactatgtcgcatattcctatcatgtaaaagaagtcaagggtacattgcccaaaaataaggcaacccaagaagaattttgcaagtatgtccttggaaaggtaaagaacatcgaatgcagtgaagctgataaggttgattttgatgaaatgattcagcgtcttacagacaattcctttatgccgaaacaagtatcaggtgaaaacagggttatcccttaccagctttactattatgaactaaagactattttgaataaagccgcttcttatctgccttttttgacccaatgcggaaaagatgccatctccaatcaagataagctcctttccatcatgacctttcggattccgtatttcgttgggcccttgcgcaaggacaattcagagcatgcctggctggaacgaaaagcagggaaaatctatccgtggaattttaacgacaaagttgaccttgataaaagtgaagaagcgttcattcggagaatgacgaatacctgcacttattatcccggtgaagatgttttgccacttgactcccttatttatgaaaaattcatgatcctcaatgaaatcaataatatccgaattgatggttatcctatttctgtagatgtaaaacagcaggtttttggcctctttgaaaagaagagaagagtgaccgtaaaggatatccagaatctcctgctttccttgggtgccttggataagcatggtaaattgacgggaatcgatactaccatccatagcaattacaatacataccatcattttaaatcgctcatggagcgtggcgttcttactcgtgatgatgtggaacgcattgtggagcgtatgacctatagtgatgatacaaaacgcgtccgtctttggctgaacaataattatggaacgctcactgctgacgacgtaaagcatatttcaaggctccgaaagcatgattttggccggctttccaaaatgttcctcacaggcctaaagggagttcataaggaaacgggggaacgagcttccattttggattttatgtggaataccaatgataacttgatgcagcttttatctgaatgttatactttttcggatgaaattaccaagctgcaggaagcatactatgccaaggcgcagctttccctgaatgattttctggactccatgtatatttcaaatgctgtcaaacgtcctatctatcgaactcttgccgttgtaaatgacatacgcaaagcctgtgggacggcgccaaaacgcatttttatcgaaatggcaagagatggggaaagcaaaaagaaaaggagcgtaacaagaagagaacaaatcaagaatctttataggtccatccgcaaggattttcagcaggaggtagatttccttgaaaaaatccttgaaaacaaaagcgatggacagctgcaaagcgatgcgctctatctatactttgcgcagcttggaagggatatgtataccggggaccctatcaagttggagcatatcaaggaccagtccttctataatattgatcatatctatccccaaagcatggtcaaggacgatagtcttgataacaaggtgttggttcaatcggaaattaatggagagaagagcagtcgatatcctcttgatgctgctatccgtaataaaatgaagcctctttgggatgcttattataaccatggcctgatttccctcaagaagtatcagcgtttgacgcggagcactccctttacagatgatgaaaagtgggatttcatcaatcggcagcttgttgagacaagacaatccacgaaggccttggcaatcttactaaaaaggaagttccctgatacggagattgtctactccaaggcagggctttcttctgattttcggcatgagtttggtctcgtaaaatcgaggaatatcaatgacctgcaccatgcaaaggacgcatttcttgcgattgtaacaggaaatgtctatcatgaacgctttaatcgccggtggtttatggtgaaccagccctattccgtcaagaccaagacgttgtttacgcattctattaaaaatggtaattttgtagcttggaatggagaagaggatcttggccgcattgttaaaatgttaaagcaaaataagaacactattcatttcacgcggttctcttttgatcgaaaggaaggcctgtttgatattcagccactaaaagcgtcaaccggtcttgtaccaagaaaagccggactagacgtggtaaaatatggtggctatgacaaatcgacagcagcttattatctccttgttcgatttacactagaagataaaaagactcaacataaattgatgatgattcctgtagaaggcttgtataaagctcgaattgaccatgataaggaattcttaacggactatgcacaaactacaatcagtgaaatcctacaaaaagataaacaaaaggtgataaatataatgtttccaatgggaacaaggcacattaaactgaattccatgatttcaatcgatggtttttatctttccattggaggaaagtctagtaagggaaaatcggtgttgtgtcatgctatggtacctcttattgtacctcataagatagaatgttatattaaggcgatggagtcttttgcacgtaaatttaaagaaaataataaattaaggattgtggaaaagtttgataagattacggtggaagataacttgaacctatacgaactatttttacaaaaacttcaacataacccatataataagttcttctccacacaatttgatgtgctgactaatggaagaagtacatttactaaattatctccagaggaacaagttcaaacgttattgaatatcttatcaatttttaaaacttgtcggagctctggctgcgatttaaaatccattaacggttctgctcaagctgccagaattatgatcagcgcagatttaactggactctcaaaaaaatattccgatattcggcttgttgagcaatcagcatctggactttttgttagtaaatcacaaaatcttttggagtatttatga

SEQ ID NO: 22 - DNA, 4005 bp, Artificial Sequence
  Description of Artificial Sequence: Synthetic polynucleotide
atgtcttcattaacaaaatttacaaataaatacagtaagcagctaaccataaaaaatgaactcatcccagtaggaaagactctcgagaacattaaggaaaacggtctcatagatggagatgaacagctaaacgagaattatcaaaaagcaaagataatcgttgatgattttctacgagatttcataaataaagctttaaataatacccaaataggaaattggagagaattagcagatgctttaaataaagaagatgaagataacatagaaaagctccaagacaaaatcagaggaataattgtaagtaaattcgagacatttgatttgttttcttcttactcgataaagaaagacgaaaagataatagatgatgataatgatgttgaagaagaggagctagatctaggaaaaaaaacttcctcatttaaatatatttttaagaaaaacctttttaaattagtacttccttcttatttaaagacaacaaatcaggataaactgaaaataatctcttcttttgataatttttctacctatttcagaggattctttgagaacagaaaaaatattttcactaagaagcctatatctacgtcaattgcctacagaattgtccatgataactttccaaagtttctagataacatcagatgttttaatgtgtggcaaacagaatgcccacagttaattgtaaaggctgataattatttaaaatcaaagaacgtcatagctaaagataaatctttagcaaactattttactgtaggagcatatgattacttcttatcccagaatggcattgatttctacaacaacattatcggcggtctaccagcatttgctggtcatgagaaaatccaaggacttaatgaatttataaatcaagaatgccaaaaggacagcgaactaaaatctaaactgaaaaacagacatgctttcaaaatggctgttctatttaagcaaattctttcagatagagaaaaaagttttgttatagacgagttcgaatctgatgctcaggtcatagatgcggttaagaacttctatgcagaacaatgtaaggataataatgttatttttaaccttctaaatcttatcaagaatatagcgttcttatctgatgatgaattagatggaatttttatagaaggcaagtatttaagctctgtttcccaaaagctatattcagattggtcgaagcttcgaaatgatattgaagatagtgcaaacagtaaacaaggaaataaagagttagcaaagaaaattaaaacaaataaaggcgatgttgaaaaggccataagtaaatatgagttttctttatcagaacttaactcaattgtacatgataatacaaaattcagtgaccttctttcttgtacgttacataaagtggctagcgaaaaactagtgaaagttaatgaaggggactggccaaaacacctgaaaaataatgaagaaaaacaaaagataaaagagcctttagatgcattgttagaaatttataatacattgctgatattcaactgcaagtcatttaataagaacggtaatttctatgttgattatgacagatgcataaatgagctttctagtgttgtttatttatataacaaaacaagaaattactgtacaaagaaaccttataacacagacaaattcaaattaaactttaacagtcctcaattaggagagggctttagtaagtcgaaagaaaatgactgtctgacattattatttaaaaaagacgacaattactatgttggaattatcagaaaaggggcaaaaattaactttgatgatacacaagccattgcagacaatacagataactgtatatttaagatgaattatttcctattaaaagatgctaaaaagtttattcctaaatgttcaattcagttaaaagaagtaaaagcacattttaaaaaatcagaggatgattatatcctgagtgacaaagaaaaatttgcctctccccttgttattaagaaatcaacatttttattagcaacagcacatgtaaaaggaaagaaaggaaacataaaaaaattccaaaaggaatattctaaggaaaatccaacagaatatagaaattctctgaatgaatggattgcattttgtaaagaatttctaaaaacatataaggcggcaacaatctttgacattacaacgttaaaaaaagctgaagaatatgctgatattgttgagttttataaggatgtagataatctttgttataaactagagttttgccctattaaaacatctttcattgagaatcttattgataatggggacttatatttattcagaatcaataataaagatttcagttcaaaatctactggtacaaagaatcttcatacgctctatcttcaggcaatctttgatgaaagaaacctcaataatcctactattatgttaaatggcggagcagagttattttatcgaaaagaaagcattgaacagaaaaataggataactcataaggcaggatcaattcttgtaaacaaggtttgtaaggatggaacaagtctagatgacaaaatcagaaacgaaatatatcaatatgaaaacaagtttattgatacattgtctgatgaagctaaaaaagttttacctaatgtaataaaaaaagaagcaactcacgacataacaaaagataagcgatttacatcagataagttctttttccattgcccattaacaattaactataaggaaggagatacaaaacaatttaacaatgaggttttatctttccttagaggtaatccagacattaatatcatcggaattgacagaggagaaagaaaccttatatacgtaactgttattaatcagaaaggcgaaatacttgacagcgtttcgtttaacacagtaacaaacaagtcgagcaaaattgaacaaactgttgattatgaggaaaagcttgctgttagggaaaaagaaagaatagaagcaaaaagatcctgggattcaatatcaaagatagcaaccttaaaagaaggttatctatcagctattgttcatgagatatgcctactgatgatcaaacacaacgcaatcgttgtacttgagaatctaaatgcaggatttaagagaattagaggaggattatcagaaaagtctgtttatcagaaattcgagaagatgcttattaacaaactaaattactttgtatctaaaaaagaatcagactggaataaacctagtggacttttaaatggtttacaactttcagaccagttcgagtcatttgagaaattaggaattcaatctgggttcatcttctatgttcctgcagcatatacatctaagattgatcctacaacaggatttgcaaatgttcttaacttatccaaggtaagaaatgttgatgcaataaagagttttttcagtaatttcaatgaaatttcatatagcaaaaaagaagctctctttaaattctcttttgatttagattccttatcaaagaagggcttcagctcatttgtaaaattcagtaaatctaaatggaatgtatatacatttggagagagaataataaaaccaaagaataagcaagggtatcgtgaagataagagaattaatttaacatttgaaatgaaaaaacttctgaatgaatataaagtaagttttgatcttgaaaacaacttaattccaaatctaacctctgcaaatctgaaagataccttctggaaagaactattctttatttttaaaacaactctgcagcttagaaacagtgtaacaaatggcaaagaagatgtactgatttctccagtaaagaacgctaaaggagagttctttgtatcaggaactcataacaagacattacctcaagactgtgatgcaaatggagcatatcatatcgccctaaaaggtctgatgattcttgaacgtaacaatcttgttagagaagaaaaagacacaaagaagataatggcaatttctaatgttgactggtttgagtatgttcaaaaaaggagaggtgtcctgtaa

SEQ ID NO: 23 - DNA, 3717 bp, Artificial Sequence
  Description of Artificial Sequence: Synthetic polynucleotide
atgaacaactatgatgagtttaccaaactgtacccaatacagaaaacgataaggttcgaattgaagccgcagggaagaacgatggaacacctcgaaacattcaactttttcgaagaggacagggatagagcggagaaatataagattttaaaggaagcaatcgacgagtatcataagaagtttatagacgaacatctaacaaatatgtctcttgactggaattctttaaaacagatttcagagaaatactataagagtagagaggaaaaagacaagaaagtttttctgtcagaacagaaacgcatgaggcaagagatagtttctgagttcaaaaaagacgatcggtttaaagatcttttttcaaaaaaattgttttctgaacttctcaaggaagagatttacaaaaaaggaaaccatcaggaaattgacgcattgaaaagttttgataaattctcaggctattttattgggttgcatgagaaccgaaaaaatatgtattctgacggagacgagatcacggctatctctaaccgtattgtaaatgagaatttcccgaagttcctcgacaaccttcagaaatatcaggaagctcgtaaaaaatatccagagtggatcattaaggcagaatctgctttagttgcacataatatcaagatggatgaagtcttttccttagagtatttcaacaaagtcctgaatcaagaaggaatacagagatacaatctcgccctaggtggctatgtgaccaaaagtggtgagaaaatgatggggcttaatgatgcacttaatcttgcccatcaaagtgaaaaaagcagcaagggaaggatacacatgactccactcttcaaacagattctgagtgaaaaagagtccttttcttatataccagatgtttttacagaagactctcaacttttaccatccattggtgggttctttgcacaaatagaaaatgataaggacgggaatatttttgacagagcattagaattgatatcttcttatgcagaatacgatacagaaaggatatatatcaggcaagcggacataaacagagtttctaatgttattttcggggagtggggaacactgggggggttaatgagggaatacaaagcagactctatcaacgacatcaatttggagagaacatgcaagaaggtagacaagtggctcgactcaaaggagtttgcgttatcagatgtattagaggcaataaaaagaaccggcaataatgatgcttttaatgaatatatctcaaagatgcgcactgccagggaaaagattgacgctgcaagaaaggaaatgaaattcatttcggaaaaaatatctggagacgaagaatcgatccatattatcaaaaccttattggactcggtgcaacagtttttacattttttcaatttattcaaagcgcgtcaggacattcctcttgatggagcattctatgcggagttcgatgaagtccatagcaaactgtttgctattgttccgttgtataataaggttaggaactatcttacgaaaaataaccttaacacgaaaaagataaagctaaacttcaagaatccaactctggcaaacggatgggatcaaaacaaggtatatgactacgcctccttaatctttctccgcgatggtaattattatctcggaataataaatccaaaaaggaaaaagaatattaaattcgaacaagggtctggaaatggcccattctaccggaagatggtgtacaaacaaattccagggccgaacaagaacttaccaagagtcttcctcacatctacgaaaggcaaaaaagagtacaagccgtcaaaggagataatagaaggatatgaagcggacaaacacataagaggagataaattcgatctggatttctgtcataagctgatagacttcttcaaggaatccatcgagaagcacaaggactggagtaagttcaacttctatttctctccaactgaatcatatggagacatcagcgaattctatctggatgtagaaaaacagggataccggatgcattttgagaatatttctgccgagacgattgatgagtatgtcgaaaagggggacttattcctcttccagatatacaacaaagactttgtgaaagcggcaaccggaaaaaaagatatgcacaccatttattggaacgcggcattctcgcccgagaaccttcaggatgtggtagtgaaactgaacggtgaagcagaacttttctacagagacaagagcgacatcaaggagatagttcacagggagggagagatactggtcaatcgtacctacaacggcaggacacctgtgcctgacaagatccacaaaaaattaacagattatcataatggccgtaccaaagatctcggagaagcaaaagaatacctcgataaggtcagatatttcaaagcgcactacgacatcacaaaggatcgcagatacctgaatgataaaatatacttccatgtgcctctgacattgaatttcaaagcaaacgggaagaagaatctcaataagatggtaattgaaaagttcctctcggacgaaaaagcgcatattattgggattgatcgcggggaaaggaatcttctttactattctatcattgacaggtcaggtaaaataatcgatcaacagagcctcaacgtcatcgatggattcgattaccgagagaaactgaatcagagggagatcgagatgaaggatgccagacaaagctggaatgctatcgggaagataaaggacctcaaggaagggtatctttcaaaagcggtccacgaaattaccaagatggcgatacaatacaatgccattgttgtcatggaggaactcaattatgggttcaaacgcggacgtttcaaagttgagaagcagatatatcagaaattcgagaatatgctgattgacaagatgaattatctggtattcaaggatgctccggatgaaagtccgggaggagtcctcaatgcatatcagcttactaatccgcttgaaagtttcgctaaacttgggaaacagacaggaattcttttctatgttccggcagcctatacttcgaagatagatccgacgaccgggtttgtcaatcttttcaatacttcaagtaaaacgaacgcacaggaaagaaaagaattcttgcaaaaattcgagtcgatctcctattccgctaaagacggaggaatattcgcattcgcgttcgattatcggaagttcggaacgtcaaaaacagaccacaaaaatgtatggaccgcatacacgaacggggaaaggatgaggtacataaaagagaaaaaacgcaacgaactgttcgacccctcgaaggagatcaaagaggctctcacttcatcaggaatcaaatatgacggcggacagaacatattgccagatatcctgaggagcaacaataacggtctgatctacacaatgtattcctctttcatagcggccattcaaatgagggtctatgacgggaaagaagactatatcatctcgccgataaagaacagcaagggagagttcttcaggaccgatccgaaaagaagggaacttccgatagacgcggatgcgaacggcgcgtataacattgctctcaggggcgaattgacgatgcgtgcgatagcggagaagttcgatccggactcggaaaagatggcgaagctagaactgaaacataaggactggttcgaattcatgcagacaaggggggattga

SEQ ID NO: 24 - DNA, 3897 bp, Artificial Sequence
  Description of Artificial Sequence: Synthetic polynucleotide
atgacaaaaacatttgattcagaattttttaatttatattctcttcaaaaaacagttcgttttgaactcaagccggttggtgaaacagcctcgtttgttgaagattttaaaaacgaaggtttgaaacgagttgtttcagaggatgaacggcgtgcggttgattaccaaaaagtgaaagaaattattgatgactaccaccgagattttattgaagaatcgctgaactattttcctgagcaggtctcaaaagacgctttggaacaagcttttcacctttatcaaaaactaaaagccgctaaggttgaagagcgtgaaaaagcattgaaagaatgggaagcccttcagaaaaaactgcgcgaaaaagttgttaaatgtttttcagattcaaacaaagcacgcttttcccgcattgataaaaaagaactgattaaagaagatttaattaactggttggttgcacaaaatcgcgaagatgacattccaaccgttgaaacctttaacaactttacgacttattttacggggtttcatgaaaaccgaaaaaacatttattcaaaagacgatcatgccacagccatttcatttcgactcattcatgaaaacctgcctaagttttttgataatgtgatcagctttaataaattgaaggaaggatttccagagctgaaatttgataaggttaaggaagatttagaagttgattatgacttgaaacatgcctttgaaatcgaatactttgtcaattttgttacccaagccggaattgaccaatataactatcttttggggggtaaaaccttagaagacggcaccaaaaagcaaggcatgaatgaacaaatcaatctgttcaagcaacagcaaacccgagacaaagcccgacaaattcccaaactcataccattgtttaaacaaattctaagcgaacgaacggaaagccaatcgtttattccaaaacaatttgaatcagaccaagagctatttgactcactgcaaaaactgcataacaactgccaagataaatttaccgtactgcaacaagccattttaggcttagccgaagcagatctgaaaaaagtattcattaaaacatctgatcttaatgcgctatcaaataccatttttggaaattacagtgtgttttcggatgcgttgaatttatacaaagaatcgctcaaaacaaaaaaggcgcaagaagcgtttgaaaaactacccgctcacagcattcatgacttgattcaatatttggagcaatttaatagctctttggatgcagaaaaacagcaatcaactgacaccgtactgaattactttattaaaacagacgagctgtattctcggttcataaaatcaacgagcgaagccttcacacaagtacaaccactctttgaattggaagcattaagctcaaaacgtcgtccaccggaaagtgaagacgaaggcgcaaaaggtcaggaagggtttgagcaaattaaacgcataaaagcctatttggataccttgatggaggcggtgcattttgcaaaaccactttatctggtgaaggggcgcaaaatgattgaaggtctggacaaagaccaaagtttctatgaagcctttgaaatggcttaccaagaactagaaagtctgattattccaatctacaacaaagctcgtagttatttaagtcgtaaaccgtttaaagcggacaaattcaaaattaattttgataataatacattgctttccggttgggatgctaataaagaaacggctaacgcttcaattttgtttaagaaggatggtttgtattatttaggaatcatgcctaaaggaaaaacgtttttgttcgattacttcgtttcatcggaagattctgaaaagttaaaacaaagaagacaaaaaaccgccgaagaagcgcttgcgcaagatggcgaaagctactttgaaaaaattcgttacaagctgttacctggcgccagcaaaatgttgccgaaagtatttttttccaacaaaaacatagggttttacaacccaagtgatgacatacttcgtatcaggaatacagcctctcacactaaaaacggaacaccgcaaaaagggcactctaaagtagagtttaatttgaatgattgtcataagatgattgatttctttaaatcaagcattcaaaagcatccagagtggggaagttttggattcaccttttcagatacatcagattttgaagatatgagcgccttttatcgagaagtcgaaaaccaaggttatgtcattagtttcgataaaataaaagaaacttacattcagagtcaagttgaacaggggaacctatatttattccaaatctacaataaagacttctcgccctacagcaaaggcaaaccaaatttacacacgctttactggaaagcgttgtttgaggaagccaacctaaataatgtggtggcaaaactcaatggtgaagctgaaattttctttaggcgacactcaatcaaagcatctgataaagtggtgcacccagcgaatcaagccattgacaataaaaacccgcataccgaaaaaacgcaaagcacctttgaatatgatcttgtaaaagacaagcgctatacccaagacaaattcttcttccatgtaccgatttcattgaactttaaggcacaaggtgtttcaaaatttaacgataaagtgaatggatttttaaagggtaacccagatgtcaatattattggcattgaccgaggcgaacgacaccttctgtatttcactgtggtgaatcagaaaggtgaaattttggttcaagagtcgcttaataccctaatgagtgataaagggcatgtgaatgactaccagcaaaaactcgacaaaaaagaacaagaacgcgatgccgctcgcaaaagctggacgacggttgaaaatatcaaagaattaaaagaaggctatttatctcatgttgttcataagttggcacacctgattattaaatacaatgccattgtttgcttggaagacctgaattttggtttcaaacgcgggcgttttaaagtggaaaaacaagtttatcagaaatttgaaaaagcgcttattgataagcttaactacttggtatttaaagaaaaagagttaggcgaggtgggccattatctaaccgcctatcagttgaccgcaccgtttgaaagtttcaagaagttaggcaagcaaagtggcatattgttttatgttccggcggattacacctccaaaattgacccaaccaccgggtttgtcaactttcttgatctgcgttatcagagtgtcgaaaaagccaaacagctcttaagcgactttaatgccattcgttttaattcagtacaaaactattttgagttcgaaatagattacaaaaaactcacacccaaacgtaaagttggtactcagagtaaatgggtgatttgtacctatggagatgtccgctatcaaaatcggcgtaatcaaaaaggtcactgggaaacggaagaagtcaatgtgactgaaaaactaaaagcccttttcgccagtgattccaaaactacaaccgtaatcgattacgccaatgacgacaacctaattgacgtcattctggaacaggacaaagccagcttcttcaaagaactgttatggttattaaaactcaccatgacgctccgccacagcaaaatcaaaagtgaagacgactttattctttcacccgttaaaaacgaacaaggcgagttttacgatagtcgaaaagcgggcgaggtgtggcctaaagatgcagacgccaatggcgcttatcacatagcgttgaaaggcttgtggaatctgcaacagatcaatcagtgggaaaagggtaaaacacttaatctggcgattaaaaaccaggattggttcagttttattcaagaaaagccctatcaagaataa

SEQ ID NO: 25 - DNA, 3708 bp, Artificial Sequence
  Description of Artificial Sequence: Synthetic polynucleotide
atgcacacaggcggattacttagcatggatgccaaggagtttaccggacagtaccccctttcgaagactctgcgttttgaactgagaccgataggcagaacgtgggacaatctcgaagcatcggggtatcttgcggaggacagacaccgtgcagaatgctatcccagggcaaaagagctcttggacgacaaccatcgtgcattcctcaaccgtgtcctgcctcagatcgatatggattggcacccgatcgcagaggcattctgcaaagtccacaagaatccgggaaacaaggaattggctcaggattacaatcttcagctgtccaaacgcagaaaggagatttcggcctatctgcaggatgcggacggctataaaggtctgtttgccaaacctgcattggatgaagcaatgaagatcgcgaaagaaaacggaaatgaatcggacatagaggttcttgaggcattcaacggtttctccgtatacttcaccggatatcatgagagcagggagaacatctattcggacgaggatatggtgtcggtagcttatcgcatcaccgaagacaatttcccgagattcgtttccaatgcgcttatattcgataagctgaatgagtcgcaccccgatataatctcggaagtatccggaaatctgggcgtagacgacatcggaaaatattttgatgtgtctaactacaataatttcctgtcgcaggccggtatagatgactacaatcacatcatcggcggccatacgacggaggacggtctgatccaggcattcaatgttgttctgaatctcaggcatcagaaagaccccggattcgaaaaaatccaattcaaacagctgtacaaacagatactcagcgtccgtacatccaaatcctatatcccgaaacagttcgataattcgaaggagatggtggactgcatctgcgactatgtgtccaagatcgaaaaatccgaaacggtcgagagagcattgaagctggtaaggaacatatcttcttttgatttgcgcggaatattcgtaaacaagaagaatctccgcattctttccaacaaactgattggtgattgggacgcgatcgaaaccgcgctgatgcactcctcctcttcggaaaatgataagaaatccgtctacgacagcgccgaggcatttacgctggatgatatcttttcgtccgttaaaaaattctcagatgcatctgcagaggatatcggaaaccgggcggaggacatatgcagagtcatatctgagaccgctccgttcataaacgatctgagggctgtcgatttggacagtttgaatgacgacggttacgaggcggcggtttccaagataagggaatctctggaaccatatatggatctgtttcatgaactggagatattctccgtaggcgatgaattcccgaaatgtgcagctttctacagtgaacttgaagaagtctccgaacagctaatcgagattataccgttattcaacaaggcccgttcgttctgtacgcgcaagagatacagtacggacaagataaaggtcaatttgaaattcccgacactcgccgacggatgggatctcaacaaagaacgcgacaacaaagccgcaatactcaggaaagacggaaagtactacctggccatactggatatgaagaaagatctttcttcgatcagaacttcggatgaagacgaatccagttttgagaaaatggagtacaagcttcttccgagtccggtaaagatgctgccaaagatcttcgtaaaatcgaaggcggccaaggagaagtacggtctgaccgaccgtatgctggagtgctacgataaagggatgcacaagagcggcagtgcattcgatctcggattttgtcacgaattgatcgattactacaagaggtgcatcgcagaatatcccggctgggacgtcttcgatttcaagttcagggaaacatcggattatggcagcatgaaggagttcaatgaggatgttgcaggggccggatactatatgtccctcagaaagatcccttgttcggaggtctacaggcttcttgatgagaaatcgatatatcttttccagatctacaacaaagattattcggaaaacgctcatgggaataagaacatgcataccatgtattgggaagggctcttttccccccagaatctggaatcccctgtgtttaaactcagcggcggtgcggagcttttcttccgtaaatcctccatacccaatgacgccaaaacggtccatccgaagggaagcgtcctggttccgcgcaatgatgtaaacggccgcaggatacctgacagcatatatcgggagctcaccagatatttcaaccgcggagattgccgcataagcgacgaggcaaagagttatctggacaaggtgaaaaccaagaaagctgaccacgatatcgtgaaagacaggaggttcacggtggacaagatgatgttccacgtccctatcgccatgaatttcaaagcgatttcgaagccgaatctcaataaaaaggtgattgacggcataatcgacgaccaagatctgaagatcatcggcatagaccgcggagagcgcaacctcatctacgtaaccatggtggatcgcaaagggaacatcctctatcaggatagcctcaatattctgaacggatacgattaccgtaaggccctcgacgtccgcgaatatgacaataaagaggctcggaggaactggacgaaggtcgaaggcatccgtaagatgaaagaggggtatctgtcgcttgcagtcagcaaattggcagatatgatcatagagaacaatgcgattatcgtcatggaggatctcaatcacggattcaaggcagggcgttcgaagatagagaaacaggtctatcagaagttcgaatccatgctcataaacaaactcggttacatggtcctcaaggataagtctatcgatcagagcggcggagctctccacggataccagcttgccaaccatgtgacaacattggcatctgtaggtaaacaatgtggagtgatattctacatccctgctgcatttacatccaagatagatccgacaacaggatttgcagatctgttcgccctcagcaatgttaaaaacgtggcatctatgagagaatttttctccaagatgaagtctgtaatctatgataaggcggagggaaaattcgcatttaccttcgactatcttgattataatgtgaaatccgagtgcggaaggaccctttggaccgtgtatacggtcggagagagattcacatacagcagggtcaatagagaatatgtcagaaaagttccgacagacataatctacgacgcattgcaaaaggcaggaatatctgttgaaggggatctcagggacaggattgctgaatcggatggcgacactctgaagagcatattctatgcattcaagtatgcattggatatgagagtagagaaccgcgaagaggattacatacagtctcctgtcaaaaatgcctccggagaattcttctgttccaagaacgcaggcaaatcgctccctcaggattccgatgcgaacggtgcatacaatatcgcactcaaggggatcctgcagctacgtatgctttccgagcagtatgatccgaatgcagagagcatacggttgccactgataaccaacaaggcctggctgacctttatgcagtccggtatgaagacatggaagaactga

SEQ ID NO: 26 - DNA, 3783 bp, Artificial Sequence
  Description of Artificial Sequence: Synthetic polynucleotide
atggatagtttgaaagatttcaccaatctgtaccctgtcagtaagacattgagatttgaattaaagcccgttggaaagactttagaaaatatcgagaaagcaggtattttgaaagaggatgagcatcgtgcagaaagttatcggagggtgaagaaaataattgatacttatcataaggtatttatcgattcttctcttgaaaatatggctaaaatgggtattgagaatgaaataaaagcaatgctccaaagtttctgcgaattgtataaaaaagatcatcgcactgagggtgaagacaaggcattagataaaattcgagcagtacttcgtggcctgattgttggggctttcactggtgtttgcggaagacgggaaaatacagtccaaaacgagaagtacgagagtttgttcaaagaaaagttgataaaagaaattttacctgattttgtgctctctactgaggctgaaagcttgcctttctctgttgaagaagctacgaggtcactgaaggagtttgatagctttacatcctactttgctggtttttacgagaatagaaagaatatatactcgacgaaacctcaatccactgccattgcttatcgtcttattcatgagaacttgccgaagttcattgataatattcttgtttttcagaagatcaaagagcctatagccaaagagctggaacatattcgtgcggacttttctgccggggggtacataaaaaaggatgagagattggaggatattttttcgttgaactattatatccacgtgttatctcaggctgggatcgaaaaatataacgcattgattgggaagattgtgacagaaggagatggagagatgaaagggctcaatgaacacatcaacctttacaaccaacaaagaggcagagaggatcggctccctctttttaggcctctttataaacagatattgagtgacagagagcaattatcatacttgcctgagagttttgaaaaagatgaggagctcctcagggctctaaaagagttctatgatcatatcgcagaagacattctcggacgtactcaacagttgatgacttctatttcagaatatgatttatctcggatatacgtaaggaacgatagccaattgactgatatatcaaaaaaaatgttgggagattggaatgctatctacatggctagagaacgagcatatgaccacgagcaggctcccaaaagaatcacggcgaaatacgagagggacaggattaaagctcttaaaggagaagagagtataagtctggcaaatcttaatagttgtattgcctttctggacaatgttagagattgccgtgtagatacttatctttccacactgggccagaaggaaggaccacatggtctatctaatctcgttgagaacgtttttgcctcataccatgaagcagagcaattgttgagctttccataccccgaagagaataatctgattcaggacaaggacaatgtggtgttaattaagaatcttctcgacaatatcagtgatctgcagaggttcttgaaacctctttggggtatgggagacgaacccgataaagatgaaagattttatggagagtataattatatccgaggagctctagatcaggtgatccctctgtacaataaggtaaggaactacctcactcggaagccttattcgaccagaaaagtaaaactcaattttgggaattctcaattgcttagtggttgggatagaaataaggaaaaggataatagctgtgtgattttgcgtaaggggcagaacttctatttggctattatgaacaataggcacaaaagaagtttcgaaaacaaggtgttgcccgagtataaggagggagaaccttacttcgaaaagatggattataaatttttgcctgatcctaataaaatgcttcctaaggtttttctttcgaaaaaaggaatagagatatacaaaccaagtccgaagcttttagaacaatatggacatggaactcacaaaaagggagatacctttagtatggatgatttgcacgaactgatcgatttcttcaaacactcaatcgaggctcatgaagattggaagcaattcggattcaaattttctgatacggctacttatgagaatgtatctagtttctatagagaagttgaggatcaggggtataagctctctttccgaaaagtttcggaatcttatgtctattcattaatagatcaaggcaagttgtatttatttcagatatacaacaaggacttttctccctgcagcaaagggacacctaatctgcataccttgtattggagaatgctttttgacgagcgcaatttggcagatgtcatatacaaactggatgggaaggctgaaatctttttccgagagaagagtttgaaaaatgatcatcccacgcatccggctggtaagcctatcaaaaagaaaagtcgacaaaaaaaaggagaggagagtctgtttgagtatgatttagtcaaggataggcactatacgatggataagttccagtttcatgtgcctattactatgaattttaaatgttctgcaggaagcaaagtcaatgatatggttaatgctcatattcgagaggcaaaggatatgcatgtcattggaattgatcgtggagaacgcaatctgctgtatatatgcgtgatagatagtcgagggacgattttggatcaaatttctctgaatacgattaacgatatagactatcatgatttattggagagtcgagacaaagaccgtcagcaggagcgccgaaactggcaaactatcgaagggatcaaggagctaaaacaaggctaccttagtcaggcggttcatcggatagccgaactgatggtggcttataaggctgtagttgctttggaggatttgaatatggggttcaaacgtgggcggcagaaagtagaaagttctgtttatcagcagtttgagaaacagctgatagataagctcaactatcttgtggacaagaagaaaaggcctgaagatattggaggattgttgagagcctatcaatttacggccccatttaagagttttaaggaaatgggaaagcaaaacggcttcttgttttatatcccggcttggaacacgagcaacatagatccgactactggatttgttaatttatttcatgcccagtatgaaaatgtagataaagcgaagagcttctttcaaaagtttgattcaattagttacaacccgaagaaagactggtttgagtttgcattcgattataaaaactttactaaaaaggctgaaggaagtcgttctatgtggatattatgcacacatggttcccgaataaagaattttagaaattcccagaagaatggtcaatgggattccgaagaattcgccttgacggaggcttttaagtctctttttgtgcgatatgagatagattataccgctgatttgaaaacagctattgtggacgaaaagcaaaaagacttcttcgtggatcttctgaagctattcaaattgacagtacagatgcgcaacagctggaaagagaaggatttggattatctaatctctcctgtagcaggggctgatggccgtttcttcgatacaagagagggaaataaaagtctgcctaaggatgcagatgccaatggagcttataatattgccctaaaaggactttgggctctacgccagattcggcaaacttcagaaggcggtaaactcaaattggcgatttccaataaggaatggctacagtttgtgcaagagagatcttacgagaaagactga

SEQ ID NO: 27 - DNA, 3792 bp, Artificial Sequence
  Description of Artificial Sequence: Synthetic polynucleotide
atgaataatggaacaaataactttcagaattttatcggaatttcttctttgcagaagactcttaggaatgctctcattccaaccgaaacaacacagcaatttattgttaaaaacggaataattaaagaagatgagctaagaggagaaaatcgtcagatacttaaagatatcatggatgattattacagaggtttcatttcagaaactttatcgtcaattgatgatattgactggacttctttatttgagaaaatggaaattcagttaaaaaatggagataacaaagacactcttataaaagaacagactgaataccgtaaggcaattcataaaaaatttgcaaatgatgatagatttaaaaatatgttcagtgcaaaattaatctcagatattcttcctgaatttgtcattcataacaataattattctgcatcagaaaaggaagaaaaaacacaggtaattaaattattttccagatttgcaacgtcattcaaggactattttaaaaacagggctaattgtttttcggctgatgatatatcttcatcttcttgtcatagaatagttaatgataatgcagagatattttttagtaatgcattggtgtataggagaattgtaaaaagtctttcaaatgatgatataaataaaatatccggagatatgaaggattcattaaaggaaatgtctctggaagaaatttattcttatgaaaaatatggggaatttattacacaggaaggtatatctttttataatgatatatgtggtaaagtaaattcatttatgaatttatattgccagaaaaataaagaaaacaaaaatctctataagctgcaaaagcttcataaacagatactgtgcatagcagatacttcttatgaggtgccgtataaatttgaatcagatgaagaggtttatcaatcagtgaatggatttttggacaatattagttcgaaacatatcgttgaaagattgcgtaagattggagacaactataacggctacaatcttgataagatttatattgttagtaaattctatgaatcagtttcacaaaagacatatagagattgggaaacaataaatactgcattagaaattcattacaacaatatattacccggaaatggtaaatctaaagctgacaaggtaaaaaaagcggtaaagaatgatctgcaaaaaagcattactgaaatcaatgagcttgttagcaattataaattatgttcggatgataatattaaagctgagacatatatacatgaaatatcacatattttgaataattttgaagcacaggagcttaagtataatcctgaaattcatctggtggaaagtgaattgaaagcatctgaattaaaaaatgttctcgatgtaataatgaatgcttttcattggtgttcggttttcatgacagaggagctggtagataaagataataatttttatgccgagttagaagagatatatgacgaaatatatccggtaatttcattgtataatcttgtgcgtaattatgtaacgcagaagccatatagtacaaaaaaaattaaattgaattttggtattcctacactagcggatggatggagtaaaagtaaagaatatagtaataatgcaattattctcatgcgtgataatttgtactatttaggaatatttaatgcaaaaaataagcctgacaaaaagataattgaaggtaatacatcagaaaataaaggggattataagaagatgatttataatcttctgccaggaccaaataaaatgatccccaaggtattcctctcttcaaaaaccggagtggaaacatataagccgtctgcctatatattggagggctataaacaaaacaagcatattaaatcctctaaggattttgatataacattttgtcacgatttgattgattattttaagaactgtatagcaatacatcctgaatggaagaattttggctttgatttttctgacacctccacatatgaagatatcagcggattttacagagaagtcgaattacaaggttataaaatcgactggacatatatcagcgaaaaggatattgatttgttgcaggaaaaaggacagttatatttattccaaatatataacaaagatttttccaagaaaagtaccggaaatgataatcttcatactatgtatttgaagaatttgtttagtgaagagaatttaaaggatattgtactgaaattaaacggtgaggcggaaatcttctttagaaaatcaagcataaagaatccaataattcataaaaaaggctctattcttgttaatagaacatatgaagcagaggaaaaagatcaatttggaaatatccagatagtcagaaaaaacataccggaaaatatatatcaggagctttataaatatttcaatgataaaagtgataaagaactttcggatgaagcagctaagcttaagaatgtagtaggtcatcatgaggctgctacaaacatagtaaaagattatagatatacatatgataaatattttcttcatatgcctattacaatcaattttaaagccaataagacaggctttattaatgacagaatattacaatatattgctaaagaaaaggatttgcatgtaataggcattgatcgtggtgaaagaaacctgatatatgtttcagtaattgatacttgtggaaatattgttgaacaaaaatcgtttaacattgttaatggatatgattatcagattaagctcaagcagcaggagggggcgcgacaaatcgcacgaaaagaatggaaagaaatcggcaaaataaaagaaattaaagaaggctatttatctcttgtaattcatgaaatttcaaagatggttattaaatataatgccataattgcaatggaggatttaagctacggatttaaaaaaggtcgtttcaaggttgagcgacaggtttaccagaagtttgagacaatgcttatcaacaaactcaactatctggtatttaaagatatatccataacggaaaacggtggtcttctaaagggataccagcttacatatattccagataaactgaaaaatgtgggtcatcaatgtggctgtatattttatgtacctgctgcctatacatcaaaaatagatcctacaaccggatttgtaaatatattcaaatttaaagatttaacagttgatgcgaagagagaatttataaaaaaatttgacagtatcagatatgattcagaaaaaaatctgttttgttttacattcgattataataactttattacgcaaaatactgttatgtcaaagtcaagctggagtgtatatacgtacggagttaggataaaaagaagatttgtcaatggcaggttctcaaatgaatcggatacaattgatataacaaaagatatggaaaaaacactcgaaatgacagatataaattggagagatggtcatgatctgaggcaggatattattgattatgaaatcgtacaacacatatttgagatttttagattgactgtacaaatgagaaacagtttaagtgaattagaagacagggattatgaccgtttgatttctccggtgctcaatgaaaataatatattttatgattcagctaaagcaggagatgcgttacctaaagacgcagatgctaatggtgcatattgtatagctctaaaaggcttgtatgaaatcaaacaaattacagagaattggaaagaagacggtaagttttcaagagataaacttaaaatttccaataaggactggtttgactttattcaaaataaaaggtatttataa

SEQ ID NO: 28 - DNA, 3957 bp, Artificial Sequence
  Description of Artificial Sequence: Synthetic polynucleotide
atgacaaacaaatttacaaaccagtactcgctttccaaaacacttcgatttgagttgattccacaaggaaaaacattggaatttattcaagaaaaaggattgctctctcaagataaacaacgagcggagagttatcaagaaatgaaaaaaactattgataaatttcataaatactttatcgatttagctttaagcaatgctaaactaactcatttagaaacttacttggaattatacaataaaagtgctgaaacaaaaaaagaacaaaaatttaaagacgatttaaagaaagtacaagacaatttacgaaaagaaatcgttaaatctttttcagatggtgatgcaaaatcaatttttgcaattttggataaaaaagaactgattaccgtagaacttgaaaaatggtttgaaaacaacgaacaaaaagacatttattttgacgaaaaattcaaaacgtttactacttattttactggttttcatcaaaacagaaaaaacatgtattcggttgaacccaattctacagcaattgcttatcgattgattcatgaaaatttacctaaatttttagaaaatgctaaagcatttgaaaaaataaaacaagtagaaagtttgcaagttaattttagagaattaatgggggaatttggagatgaagggctaattttcgtaaatgaattagaagaaatgtttcaaatcaattattataatgatgtgctttcacaaaatggaattacaatttataatagtataatttcaggatttaccaaaaatgatataaaatataaaggtctaaatgaatacataaataattacaatcaaaccaaagacaaaaaagaccgtttgccaaaattaaaacaattgtataaacagattttgagtgataggatttcactttcgtttttgcccgatgcttttacggatgggaaacaagttttgaaagccatatttgacttttataaaatcaacttactttcttataccattgaaggacaggaagaaagccaaaatcttttactattaattcgtcagacaattgaaaacctttctagttttgatacccaaaaaatttatctaaaaaatgatacccatttaaccactatttcacaacaagtatttggcgatttttcggtgttttcaactgctttaaattattggtatgaaactaaagtaaatccaaaatttgaaacggaatatagcaaagccaacgaaaaaaaacgagaaattttagataaagccaaagcggtatttacaaaacaagattatttttcaattgcttttttacaagaagtactttcggaatacattcttaccttagatcacacttctgatattgtaaaaaagcattcctccaactgtattgcggattattttaaaaatcattttgtagccaaaaaagaaaatgaaaccgacaaaacctttgattttattgctaatattactgcaaaataccaatgtattcaaggtattttagaaaatgcagaccaatacgaagacgaactcaaacaagaccaaaaattaattgataatttgaaattctttttagatgctattttagaattgttgcattttattaaacctttgcatttaaaatcagaaagcattaccgaaaaagacactgctttttatgatgtgtttgaaaattattacgaagcattgagtttgttgaccccattatataatatggtgcgaaactatgtaacgcaaaagccgtacagcaccgaaaaaataaaattaaattttgaaaatgcacaattattgaatggttgggatgccaataaagaaggtgattacctaactaccattttgaaaaaagacggtaattattttttagccataatggataaaaagcataacaaagcgtttcaaaagtttccagaaggaaaagaaaattatgaaaaaatggtgtataaactattgcctggagtaaataagatgttgccaaaagtatttttttccaataaaaatattgcttacttcaacccatcaaaagagttattagaaaactataaaaaagagacgcacaaaaaaggagacacattcaatttagaacattgtcatacgttgatcgattttttcaaggactctttaaacaaacatgaagactggaaatactttgattttcaattttctgaaacaaaatcgtatcaagatttgagtggtttttatagagaagtagaacatcaaggctacaaaatcaattttaaaaatatcgattcagaatatattgatggtttggtgaacgaaggtaaattgtttctatttcaaatttacagcaaagatttttcgcctttttccaaagggaaaccgaacatgcacactttgtattggaaagccttatttgaagaacaaaatttgcaaaatgtaatctataaattgaatggacaagccgaaatattttttagaaaagcctctataaaacctaaaaatataatattgcacaaaaagaaaattaaaattgccaaaaagcattttattgataaaaaaacaaaaacatctgaaattgttcctgttcaaacaataaaaaacctcaatatgtactaccaaggaaaaataagtgaaaaagaattaacacaagatgatttaaggtatattgataattttagcattttcaatgaaaaaaataaaacaattgatattataaaagacaaacgatttacggttgataaatttcagtttcatgtgccgattaccatgaactttaaagcaacgggcggaagttatatcaatcaaaccgtattagaatatttgcaaaacaatcccgaagttaagattattggattggatagaggcgaacgccatttggtatatctgacactgatagaccagcaaggaaacatcttgaaacaagaaagtttgaatacaatcaccgattctaaaatctcgacaccttatcataagttgttggataacaaggaaaacgagcgtgacttggctcgaaaaaattggggaacggtggaaaacatcaaagaactcaaagaaggctacatcagtcaagtggtgcataaaattgctacgttgatgctggaagaaaatgccattgtggtaatggaagatttgaattttggatttaaacgtggacgttttaaagtggaaaaacaaatttatcaaaagctggaaaaaatgttgattgacaaattgaattatttggttttaaaagacaaacaacctcaggaattaggcggattgtacaacgcattacaactcaccaataaatttgaaagtttccaaaaaatgggtaaacaatcgggctttttgttttatgtacccgcttggaacacctccaaaatagacccaaccacagggtttgtcaattatttttataccaaatatgaaaatgttgacaaagccaaagccttttttgaaaaatttgaggcgattcgtttcaatgcagaaaagaagtattttgaatttgaagtaaaaaaatatagcgattttaacccaaaagccgaaggcactcaacaagcctggaccatttgcacgtatggcgaacgaatagaaaccaaacgacaaaaagaccaaaacaacaaatttgtaagcactccaattaatctaaccgaaaagatagaagactttttgggtaaaaaccaaattgtttatggtgatggtaattgcatcaaatctcaaattgctagcaaagacgacaaggctttttttgaaaccttattgtattggttcaaaatgactttacaaatgcgaaacagcgaaacaagaacagatatagattatctaatttcgcccgtgatgaatgacaacggaacattttacaacagccgagattatgaaaaattagaaaatccaactttgcccaaagatgccgatgccaacggagcgtatcatattgccaaaaaaggattgatgcttttgaataaaatagaccaagccgacttgacaaaaaaagtggatttatctattagtaacagagattggttgcaatttgtacaaaaaaataaataa

SEQ ID NO: 29 - DNA, 4019 bp, Artificial Sequence
  Description of Artificial Sequence: Synthetic polynucleotide
atggaacaggagtactatttaggactggatatgggaaccggatctgtaggatgggctgttacagattcggaatatcatgtcttgcgtaaacatggaaaagcactatggggagtccgattatttgaaagtgcatcgacagcagaagaacgaagaatgttccgaacatcaagaagaagactagatcgaagaaactggagaattgaaattttacaggaaatttttgcagaggaaataagtaagaaagatccaggatttttcttgcgaatgaaagaaagcaaatattatccagaagataagcgagatatcaatggaaattgtccggaactgccatatgcattatttgttgatgacgattttacagataaagattatcataaaaaatttccgacaatttatcatctcaggaaaatgttgatgaatacagaggagacaccggatatccggttggtgtatctggcaattcatcatatgatgaagcataggggccatttcttgttatctggtgacattaatgagattaaggagttcggaacgacattttcaaaattgttggagaatatcaaaaatgaggaattggattggaatcttgaactgggaaaagaagaatatgctgttgtagaaagtattttaaaagataacatgttaaaccgatccacaaagaaaaccagattaataaaagcattaaaagcaaaatcaatatgtgaaaaggctgtactgaatttattggctggtggaacggtgaaattgagtgatatatttggtcttgaagaattaaatgagacagaaagaccgaagatttcctttgctgataatggatacgatgattatatcggagaagttgaaaatgagctgggagaacaattctatattatagagacggcaaaagcagtgtatgactgggcggtattagttgaaatattgggaaaatatacgtcaatttcagaagcgaaagtagcaacgtatgaaaaacataaatcggatttacaatttttgaaaaagatagttcggaaatatctgacaaaggaggaatataaagatatttttgtaagtacgagtgacaaattgaaaaattactctgcttatataggaatgacgaaaataaatggaaaaaaggttgatttgcagagcaaacggtgcagtaaagaagaattctatgattttattaagaaaaacgtacttaaaaagctagaaggacaacctgaatatgaatatttgaaagaagagctagaaagagaaacatttctaccaaaacaggtgaacagggataatggtgtaataccgtatcagattcatttgtacgagttgaaaaagatattaggaaatttacgggataaaatagacctcattaaagagaacgaagataaactggttcaattatttgaattcagaattccgtattatgttggtccgctgaataagatagatgacggaaaagagggaaaatttacatgggctgtacggaaaagtaatgaaaagatatatccatggaattttgaaaatgtagttgatatagaagcaagtgcagaaaaatttatccggagaatgacaaataagtgtacatatctgatgggcgaagatgtattgccgaaggattcattgctttacagtaaatatatggttttaaatgaattaaataatgtaaagttggatggcgaaaaattatctgtagaattgaaacaacggttgtatacagatgtattttgtaagtatcggaaagtaactgtaaagaagataaaaaattacttgaaatgtgaaggtatcatatccggcaatgtcgaaataactggaattgatggtgattttaaggcatcgttaacggcatatcatgattttaaagaaatcttgacaggaacagaattggctaaaaaggacaaagaaaatattattaccaatatagtattgtttggagatgataaaaagctgctgaaaaagagactgaatcgattatatcctcagattacgccgaatcagttgaagaaaatatgtgcgctatcctatacaggctggggaagattttctaaaaagttcttagaagaaataacagctccagatccggaaacgggagaggtatggaatatcattacggcattgtgggaatcgaataataatctgatgcaattattaagtaatgaatatcggtttatggaagaagtcgaaacatacaatatgggaaaacagactaaaacattgtcgtacgaaacagtagagaatatgtatgtttctccatctgtgaaaagacagatatggcagacgctgaaaatcgtgaaagaattagaaaaagtaatgaaagaatctccgaaacgtgtatttattgagatggcgagagaaaagcaagaaagtaagagaaccgaatcgcgtaaaaaacaactaatagatttgtataaggcttgtaaaaatgaagaaaaagattgggtaaaagaactgggagatcaggaagaacagaaattacgaagcgataagttgtacctatattatacgcaaaagggtcgttgtatgtattctggcgaggtaatagaactgaaagacttatgggataatacaaaatatgatattgatcatatatatccacaatctaaaacgatggatgacagtcttaataatcgcgtattggtaaaaaagaaatataatgcaacaaaatcagataagtatccattaaatgaaaatatacgacatgagagaaaaggcttttggaagtcactgttagatggagggtttataagtaaagaaaaatatgaacgcttaataagaaatacagaattgagtccggaagaattagcaggatttattgaaaggcagattgttgaaacgaggcagagtacaaaagctgtagcggaaatattaaagcaagtgtttccggaaagtgaaattgtatatgtcaaagcaggtacggtttcaagattcagaaaagattttgaattactgaaagttcgagaagtgaatgatttgcatcacgcaaaggatgcgtatttaaatattgtagttggtaatagttattatgtgaaatttactaagaatgcatcatggtttataaaagaaaatccgggacgtacttacaacttaaaaaagatgtttacatcaggttggaatattgaacgaaatggagaagttgcatgggaagtcgggaaaaaaggaacaattgtaacggtaaaacaaataatgaataaaaataatatattggtgacaagacaggttcatgaagcgaaaggtgggctgtttgatcagcagattatgaaaaaaggaaaaggtcagattgctataaaggaaactgatgaacgtcttgcatcaatagaaaagtatggaggctataataaagctgccggggcatattttatgctggtagaatctaaagataaaaaaggaaaaacaattcgaacgatagaatttataccattatatttaaagaataaaatcgagtcggatgaatcaatagcattgaactttttagaaaaaggcagaggtttgaaagaaccaaagatactattgaaaaaaattaagattgatacattatttgatgtggacggattcaaaatgtggttgtctggaagaacaggggacagactactatttaaatgtgcaaatcaattgattttggatgagaaaataattgtaacaatgaaaaaaattgtaaagtttattcaaaggagacaagaaaatagagaattaaaattatctgataaagatggaattgataatgaagtacttatggaaatatataacacttttgtggataagttagaaaacacagtgtatagaatacgattatccgaacaggcaaaaacgcttatagataaacaaaaagaatttgaaaggttatcactagaggataaaagtagtactttgtttgaaattttacatatttttcagtgtcaaagtagtgcggccaatttaaaaatgataggcggacctggaaaagcaggaatattagttatgaataataatataagtaagtgtaacaaaatttctattataaatcagtctccaacaggaattttcgaaaatgagattgatttgttaaagat

SEQ ID NO: 30 - DNA, 3858 bp, Artificial Sequence
  Description of Artificial Sequence: Synthetic polynucleotide
atgaaatctttcgattcattcacaaatctttattctctttcaaaaaccttgaaatttgagatgagacctgtcggaaatacccaaaaaatgctcgacaatgcaggagtatttgaaaaagacaaactaattcaaaaaaagtacggaaaaacaaagccgtatttcgacagactccacagagaatttatagaagaagcgctcacgggggtagagctaataggactagatgagaactttaggacacttgttgactggcaaaaagataagaaaaataatgtcgcaatgaaagcgtatgaaaatagtttgcagcggctgagaacggaaataggtaaaatatttaacctaaaggctgaggattgggtaaagaacaaatatccaatattagggctgaaaaataaaaataccgatattttattcgaagaggctgtattcgggatattgaaagcccgatatggagaagaaaaagatacttttatagaagtagaggaaatagataaaaccggcaaatcaaagatcaatcaaatatcaattttcgatagttggaaaggatttacaggatatttcaaaaaattttttgaaaccagaaagaatttttacaaaaacgacggaacttctacagcaattgctacaaggatcattgatcaaaatctgaaaagattcatagataatctgtcaatagttgaaagtgtgagacaaaaggttgatctcgccgagacagaaaaatctttcagcatatctctatcgcaattcttctcaatagacttttataacaagtgtctccttcaagatggtattgattactacaacaagataatcggtggagaaactctcaaaaatggcgaaaaactaataggtctcaatgaactaataaatcaatataggcagaataataaggatcagaaaatcccatttttcaaacttcttgataaacaaattttgagtgaaaagatattatttttggatgaaataaaaaatgacacagaactgatcgaggcgctgagtcagttcgcaaaaacagccgaagaaaaaacaaaaattgtcaaaaagctttttgccgattttgtagaaaataattccaaatacgatcttgcacagatttatatttcccaagaagcattcaatactatatcaaacaagtggacaagcgaaactgagacgttcgctaaatatctattcgaagcaatgaagagtggaaaacttgcaaagtatgagaaaaaagataatagctataaatttcctgattttattgccctttcacagatgaagagtgctttattaagtatcagccttgagggacatttttggaaagagaaatactacaaaatttcaaaattccaagagaagaccaattgggagcagtttcttgcaatttttctatacgagtttaactctcttttcagcgacaaaataaatacaaaagatggagaaacaaagcaagttggatactatctatttgccaaagacctgcataatcttatcttaagtgagcagattgatattccaaaagattcaaaagtcacaataaaagattttgccgattctgtactcacaatctaccaaatggcaaaatattttgcggtagaaaaaaaacgagcgtggcttgccgagtatgaactagattcattttatacccagccagacacaggctatttacagttttatgataacgcctacgaggatattgtgcaggtatacaacaagcttcgaaactatctgaccaaaaagccatatagcgaggagaaatggaagttgaattttgaaaattctacgctggcaaatggatgggataagaacaaagaatctgataattcagcagttattctacaaaaaggtggaaaatattatttgggactgattactaaaggacacaacaaaatttttgatgaccgttttcaagaaaaatttattgtgggaattgaaggtggaaaatatgaaaaaatagtctataaatttttccccgaccaggcaaaaatgtttcccaaagtgtgcttttctgcaaaaggactcgaattttttagaccgtctgaagaaattttaagaatttataacaatgcagagtttaaaaaaggagaaacttattcaatagatagtatgcagaagttgattgatttttataaagattgcttgactaaatatgaaggctgggcatgttatacctttcggcatctaaaacccacagaagaataccaaaacaatattggagagttttttcgagatgttgcagaggacggatacaggattgattttcaaggcatttcagatcaatatattcatgaaaaaaacgagaaaggcgaacttcacctttttgaaatccacaataaagattggaatttggataaggcacgagacggaaagtcaaaaacaacacaaaaaaaccttcatacactctatttcgaatcgctcttttcaaacgataatgttgttcaaaactttccaataaaactcaatggtcaagctgaaattttttatagaccgaaaacggaaaaagacaaattagaatcaaaaaaagataagaaagggaataaagtgattgaccataaacgctatagtgagaataagattttttttcatgttcctctcacactaaaccgcactaaaaatgactcatatcgctttaatgctcaaatcaacaactttctcgcaaataataaagatatcaacatcatcggtgtagataggggagaaaagcatttagtctattattcggtgattacacaagctagtgacatcttagaaagtggctcactaaatgagctaaatggcgtgaattatgctgaaaaactgggaaaaaaggcagaaaatcgagaacaagcacgcagagactggcaagacgtacaagggatcaaagacctcaagaaaggatatatttcacaggtggtgcgaaagcttgctgatttagcaattaaacacaatgccattatcattcttgaagatttgaatatgagatttaaacaagttcggggcggtatcgaaaaatccatttatcaacagttagaaaaagcactgatagataaattaagctttcttgtagacaaaggtgaaaaaaatcccgagcaagcaggacatcttctgaaagcatatcagctttcggccccatttgagacatttcaaaaaatgggcaaacagacgggtataatcttttatacacaagcttcgtatacctcaaaaagtgaccctgtaacaggttggcgaccacacctgtatctcaaatatttcagtgccaaaaaagcaaaagacgatattgcaaagtttacaaaaatagaatttgtaaacgataggtttgagcttacctatgatataaaggactttcagcaagcaaaagaatatccaaataaaactgtttggaaagtttgctcaaatgtagagagattcaggtgggacaaaaacctcaatcaaaacaaaggcggatatactcactacacaaatataactgagaatatccaagagctttttacaaaatatggaattgatatcacaaaagatttgctcacacagatttctacaattgatgaaaaacaaaatacctcattttttagagattttattttttatttcaaccttatttgccaaatcagaaataccgatgattctgagattgctaaaaagaatgggaaagatgattttatactgtcacctgttgagccgtttttcgatagccgaaaagacaatggaaataaacttcctgagaatggagatgataacggcgcgtataacatagcaagaaaagggattgtcatactcaacaaaatctcacaatattcagagaaaaacgaaaattgcgagaaaatgaaatggggggatttgtatgtatcaaacattgactgggacaattttgtaacccaagctaatgcacggcattaa

SEQ ID NO: 31 - DNA, 3516 bp, Artificial Sequence
  Description of Artificial Sequence: Synthetic polynucleotide
atgattatcttatatattagtacctcgaatatgaacatggaaggagtatttatggaaaattttaaaaacttgtatccaataaacaaaacacttcgatttgaattaagaccctatggaaaaacattggaaaattttaaaaaatccggacttttagaaaaagatgcctttaaggcaaatagtagacgaagtatgcaagctataatcgatgaaaaattcaaagagactatcgaagaacgcttaaagtacactgaattcagtgaatgtgatcttggaaacatgacatcaaaagataaaaaaataactgataaagcagctacaaatttaaaaaagcaagttatcttatcttttgacgatgaaatatttaataattacctaaaacctgataaaaatattgacgcattatttaaaaatgatccttcaaatcctgtaatctctacatttaaaggttttacgacatattttgtgaatttttttgaaattcgaaaacatattttcaagggagaatcatcaggctcaatggcataccgaattatagatgaaaacctgacaacatacttgaataatattgaaaaaataaaaaaactgccagaagaattaaaatcacagctagaaggcattgatcagattgataaacttaataattataatgagttcattacacagtcaggtataacacactataatgaaatcatcggcggtatatcaaaatcagagaatgtcaaaatacagggaattaatgaaggaattaatctatactgtcagaagaacaaagttaaacttcctcgactgactccgctatacaaaatgatattatcagacagagtttccaactcttttgtattagacactattgaaaatgacacagaattaattgaaatgataagtgatttgattaataagactgagatttcgcaagatgttataatgtcagatattcaaaatattttcataaaatacaaacaacttggtaatttgccgggtatctcatattcttcaatagttaatgctatttgctcggattatgacaacaatttcggagatgggaagcgaaaaaaatcttacgaaaatgatcgcaaaaagcatttggagactaatgtatactccataaattatatttctgaattgcttacagataccgatgtttcatcaaatatcaagatgagatataaagagcttgagcaaaattatcaggtttgcaaagaaaattttaatgccacaaactggatgaatattaaaaatataaaacaatctgaaaaaacaaaccttattaaagatttgttagatatacttaaatcgattcaacgtttctatgatttgtttgatattgttgacgaagataaaaatccaagtgctgaattttatacctggttatcaaaaaatgctgaaaagcttgactttgaattcaattctgtatataacaagtcacgaaactatctcaccaggaaacaatactctgataaaaaaatcaagctgaattttgattctccaacattggccaaagggtgggatgctaacaaagaaatagataactccacgattataatgcgtaaatttaataatgacagaggcgattatgattacttccttggcatatggaataaatccacacctgcaaatgaaaaaataatcccactggaggataatggattattcgaaaaaatgcaatataagctgtatccagatcctagtaagatgttaccgaaacaatttctatcaaaaatatggaaggcaaagcatcctacgacacctgaatttgataaaaaatataaagagggaagacataaaaaaggtcctgatttcgaaaaagaattcctgcatgaattgattgattgcttcaaacatggtcttgttaatcacgatgaaaaatatcaggatgtttttggcttcaatctccgtaacactgaagattataattcatatacagagtttctcgaagatgtggaaagatgcaattacaatctttcatttaacaaaattgctgatacttcaaaccttattaatgatgggaaattgtatgtatttcagatatggtcaaaagacttttctattgattcaaaaggtactaaaaacttgaatacaatctattttgaatcactattttcagaagaaaacatgatagaaaaaatgttcaagctttctggagaggctgagatattctatcgaccagcatcgttgaattattgtgaagatatcataaaaaaaggtcatcaccatgcagaattaaaagataagtttgactatcctataataaaagataagcgatattcacaagataagtttttctttcatgtgccaatggttataaattataaatctgagaaactgaattccaaaagccttaacaaccgaacaaatgaaaacctgggacagtttacacatattataggtatagacaggggcgagcggcacttgatttatttaactgttgttgatgtttccactggtgaaatcgttgaacagaaacatctggacgaaattatcaatactgataccaagggagttgaacacaaaacccattatttgaataaattggaagaaaaatctaaaacaagagataacgagcgtaaatcatgggaagctattgaaactatcaaagaattaaaagaaggctatatttctcatgtaattaatgaaatacaaaagctgcaagaaaaatataatgccttaatcgtaatggaaaatcttaactatgggttcaaaaactcacgaatcaaagttgaaaaacaggtttatcaaaaattcgagacagcattgattaaaaagttcaattatattattgataaaaaagatccagaaacctatatacatggttaccagcttacaaatcctattaccactctggataagattggaaatcaatctggaatagtgctgtatattcctgcgtggaatacttctaagatagatcccgtcacaggatttgtaaaccttctgtacgcagatgatttgaagtataaaaatcaggagcaggccaaatcattcattcagaaaatagacaacatatattttgaaaatggagagtttaaatttgatattgatttttccaaatggaataatcgctactcaataagtaaaactaaatggacgttaacaagttatgggactcgcatccagacatttagaaatccccagaaaaacaataagtgggattctgctgaatatgatttgacagaagagtttaaattaattttaaatatagacggaacgttaaagtcacaggacgtagaaacatacaaaaaattcatgtctttatttaaactaatgctacagcttcgaaactctgttacaggaaccgacattgattatatgatctctcctgtcactgataaaacaggaacacatttcgattcaagagaaaatattaaaaatcttcctgccgatgcagatgccaatggtgcctacaacattgcgcgcaaaggaataatggctattgaaaatataatgaacggtataagcgatccactaaaaataagcaacgaagactatttaaagtatattcagaatcaacaggaataa

SEQ ID NO: 32 - DNA, 3924 bp, Artificial Sequence
  Description of Artificial Sequence: Synthetic polynucleotide
atgacccaatttgaaggttttaccaatttataccaagtttcgaagacccttcgttttgaactgattccccaaggaaaaacactcaaacatatccaggagcaagggttcattgaggaggataaagctcgcaatgaccattacaaagagttaaaaccaatcattgaccgcatctataagacttatgctgatcaatgtctccaactggtacagcttgactgggagaatctatctgcagccatagactcctatcgtaaggaaaaaaccgaagaaacacgaaatgcgctgattgaggagcaagcaacatatagaaatgcgattcatgactactttataggtcggacggataatctgacagatgccataaataagcgccatgctgaaatctataaaggactttttaaagctgaacttttcaatggaaaagttttaaagcaattagggaccgtaaccacgacagaacatgaaaatgctctactccgttcgtttgacaaatttacgacctatttttccggcttttatgaaaaccgaaaaaatgtctttagcgctgaagatatcagcacggcaattccccatcgaatcgtccaggacaatttccctaaatttaaggaaaactgccatatttttacaagattgataaccgcagttccttctttgcgggagcattttgaaaatgtcaaaaaggccattggaatctttgttagtacgtctattgaagaagtcttttcctttcccttttataatcaacttctaacccaaacgcaaattgatctttataatcaacttctcggcggcatatctagggaagcaggcacagaaaaaatcaagggacttaatgaagttctcaatctggctatccaaaaaaatgatgaaacagcccatataatcgcgtccctgccgcatcgttttattcctctttttaaacaaattctttccgatcgaaatacgttatcctttattttggaagaattcaaaagcgatgaggaagtcatccaatccttctgcaaatataaaaccctcttgagaaacgaaaatgtactggagactgcagaagcccttttcaatgaattaaattccattgatttgactcatatctttatttcccataaaaagttagaaaccatctcttcagcgctttgtgaccattgggataccttgcgcaatgcactttacgaaagacggatttctgaactcactggcaaaataacaaaaagtgccaaagaaaaagttcaaaggtcattaaaacatgaggatataaatctccaagaaattatttctgctgcaggaaaagaactatcagaagcattcaaacaaaaaacaagtgaaattctttcccatgcccatgctgcacttgaccagcctcttcccacaacattaaaaaaacaggaagaaaaagaaatcctcaaatcacagctcgattcgcttttaggcctttatcatcttcttgattggtttgctgtcgatgaaagcaatgaagtcgacccagaattctcagcacggctgacaggcattaaactagaaatggaaccaagcctttcgttttataataaagcaagaaattatgcgacaaaaaagccctattcggtggaaaaatttaaattgaattttcaaatgccaacccttgcctctggttgggatgtcaataaagaaaaaaataatggagctattttattcgtaaaaaatggtctctattaccttggtatcatgcctaaacagaaggggcgctataaagccctgtcttttgagccgacagaaaaaacatcagaaggattcgataagatgtactatgactacttcccagatgccgcaaaaatgattcctaagtgttccactcagctaaaggctgtaaccgctcattttcaaactcataccacccccattcttctctcaaataatttcattgaacctcttgaaatcacaaaagaaatttatgacctgaacaatcctgaaaaggagcctaaaaagtttcaaacggcttatgcaaagaagacaggcgatcaaaaaggctatagagaagcgctttgcaaatggattgactttacgcgggattttctctctaaatatacgaaaacaacttcaatcgatttatcttcactccgcccttcttcgcaatataaagatttaggggaatattacgccgaactgaatccgcttctctatcatatctccttccaacgaattgctgaaaaggaaatcatggatgctgtagaaacgggaaaattgtatctgttccaaatctacaataaggattttgcgaagggccatcacgggaaaccaaatctccacaccctgtattggacaggtctcttcagtcctgaaaaccttgcgaaaaccagcatcaaacttaatggtcaagcagaattgttctatcgacctaaaagccgcatgaagcggatggcccatcgtcttggggaaaaaatgctgaacaaaaaactaaaggaccagaagacaccgattccagataccctctaccaagaactgtacgattatgtcaaccaccggctaagccatgatctttccgatgaagcaagggccctgcttccaaatgttatcaccaaagaagtctcccatgaaattataaaggatcggcggtttacttccgataaatttttcttccatgttcccattacactgaattatcaagcagccaatagtcccagtaaattcaaccagcgtgtcaatgcctaccttaaggagcatccggaaacgcccatcattggtatcgatcgtggagaacgcaatctaatctatattaccgtcattgacagtactgggaaaattttggagcagcgttccctgaataccatccagcaatttgactaccaaaaaaaattggacaacagggaaaaagagcgtgttgccgcccgtcaagcctggtccgtcgtcggaacgatcaaagaccttaaacaaggctacttgtcacaggtcatccatgaaattgtagacctgatgattcattaccaagctgttgtcgtccttgaaaacctcaacttcggatttaaatcaaaacggacaggcattgccgaaaaagcagtctaccaacaatttgaaaagatgctaatagataaactcaactgtttggttctcaaagattatcctgctgagaaagtgggaggcgtcttaaacccgtatcaacttacagatcagttcacgagctttgcaaaaatgggcacgcaaagcggcttccttttctatgtaccggccccttatacctcaaagattgatcccctgactggttttgtcgatccctttgtatggaagaccattaaaaatcatgaaagtcggaagcatttcctagaaggatttgatttcctgcattatgatgtcaaaacaggtgattttatcctccattttaaaatgaatcggaatctctctttccagagagggcttcctggcttcatgccagcttgggatattgttttcgaaaagaatgaaacccaatttgatgcaaaagggacgcccttcattgcaggaaaacgaattgttcctgtaatcgaaaatcatcgttttacgggtcgttacagagacctctatcccgctaatgaactcattgcccttctggaagaaaaaggcattgtctttagagacggaagtaatatattacccaaacttttagaaaatgatgattctcatgcaattgatacgatggtcgccttgattcgcagtgtactccaaatgagaaacagcaatgccgcaacgggggaagactacatcaactctcccgttagggatctgaacggggtgtgtttcgacagtcgattccaaaatccagaatggccaatggatgcggatgccaacggagcttatcatattgccttaaaagggcagcttcttctgaaccacctcaaagaaagcaaagatctgaaattacaaaacggcatcagcaaccaagattggctggcctacattcaggaactgagaaactga

SEQ ID NO: 33 - DNA, 3390 bp, Artificial Sequence
  Description of Artificial Sequence: Synthetic polynucleotide
atggccgtcaaatccatcaaagtgaaacttcgtctcgacgatatgccggagattcgggccggtctatggaaacttcataaggaagtcaatgcgggggttcgatattacacggaatggctcagtcttctccgtcaagagaacttgtatcgaagaagtccgaatggggacggagagcaagaatgtgataagactgcagaagaatgcaaagccgaattgttggagcggctgcgcgcgcgtcaagtggagaatggacaccgtggtccggcgggatcggacgatgaattgctgcagttggcgcgtcaactctatgagttgttggttccgcaggcgataggtgcgaaaggcgacgcgcagcaaattgcccgcaaatttttgagccccttggccgacaaggacgcagttggtgggcttggaatcgcgaaggcggggaacaaaccgcggtgggttcgcatgcgcgaagcgggggaaccaggctgggaagaggagaaggagaaggctgagacgaggaaatctgcggatcggactgcggatgttttgcgcgcgctcgcggattttgggttaaagccactgatgcgcgtatacaccgattctgagatgtcatcggtggagtggaaaccgcttcggaagggacaagccgttcggacgtgggatagggacatgttccaacaagctatcgaacggatgatgtcgtgggagtcgtggaatcagcgcgttgggcaagagtacgcgaaactcgtagaacaaaaaaatcgatttgagcagaagaatttcgtcggccaggaacatctggtccatctcgtcaatcagttgcaacaagatatgaaagaagcatcgcccggactcgaatcgaaagagcaaaccgcgcactatgtgacgggacgggcattgcgcggatcggacaaggtatttgagaagtgggggaaactcgcccccgatgcacctttcgatttgtacgacgccgaaatcaagaatgtgcagagacgtaacacgagacgattcggatcacatgacttgttcgcaaaattggcagagccagagtatcaggccctgtggcgcgaagatgcttcgtttctcacgcgttacgcggtgtacaacagcatccttcgcaaactgaatcacgccaaaatgttcgcgacgtttactttgccggatgcaacggcgcacccgatttggactcgcttcgataaattgggtgggaatttgcaccagtacacctttttgttcaacgaatttggagaacgcaggcacgcgattcgttttcacaagctattgaaagtcgagaatggtgtcgcaagagaagttgatgatgtcaccgtgcccatttcaatgtcagagcaattggataatctgcttcccagagatcccaatgaaccgattgcgctatattttcgagattacggagccgaacagcatttcacaggtgaatttggtggcgcgaagatccagtgccgccgggatcagctggctcatatgcaccgacgcagaggggcgagggatgtttatctcaatgtcagcgtacgtgtgcagagtcagtctgaggcgcggggagaacgtcgcccgccgtatgcggcagtatttcgtctggtcggggacaaccatcgcgcgtttgtccatttcgataaactatcggattatcttgcggaacatccggatgatgggaagctcgggtcggaggggttgctttccgggctgcgggtgatgagtgtcgatctcggccttcgcacatctgcatcgatttccgtttttcgcgttgcccggaaggacgagttgaagccgaactcaaaaggtcgtgtaccgtttttctttccgataaaagggaatgacaatctcgtcgcggttcatgagcgatcacaactcttgaagctgcctggcgaaacggagtcgaaggacctgcgtgctatccgagaagaacgccaacggacattgcggcagttgcggacgcaactggcgtatttgcggctgctcgtgcggtgtgggtcggaagatgtggggcggcgtgaacggagttgggcaaagcttatcgagcagccggtggatgcggccaatcacatgacaccggattggcgcgaggcttttgaaaacgaacttcagaagcttaagtcactccatggtatctgtagcgacaaggaatggatggatgctgtctacgagagcgttcgccgcgtgtggcgtcacatgggcaaacaggttcgcgattggcgaaaggacgtacgaagcggagagcggcccaagattcgcggctatgcgaaagacgtggtcggtggaaactcgattgagcaaatcgagtatctggaacgtcagtacaagttcctcaagagttggagcttctttggtaaggtgtcgggacaagtgattcgtgcggagaagggatctcgttttgcgatcacgctgcgcgaacacattgatcacgcgaaggaagatcggctgaagaaattggcggatcgcatcattatggaggctctcggctatgtgtacgcgttggatgagcgcggcaaaggaaagtgggttgcgaagtatccgccgtgccagctcatcctgctggaggaattgagcgagtaccagttcaataacgacaggcctccgagcgaaaacaaccagttgatgcaatggagtcatcgcggcgtgttccaggagttgataaatcaggcccaagtccatgatttactcgttgggacgatgtatgcagcgttctcgtcgcgattcgacgcgcgaactggggcaccgggtatccgctgtcgccgggttccggcgcgttgcacccaggagcacaatccagaaccatttccttggtggctgaacaagtttgtggtggaacatacgttggatgcttgtcccctacgcgcagacgacctcatcccaacgggtgaaggagagatttttgtctcgccgttcagcgcggaggagggggactttcatcagattcacgccgacctgaatgcggcgcaaaatctgcagcagcgactctggtctgattttgatatcagtcaaattcggttgcggtgtgattggggtgaagtggacggtgaactcgttctgatcccaaggcttacaggaaaacgaacggcggattcatatagcaacaaggtgttttataccaatacaggtgtcacctattatgagcgagagcgggggaagaagcggagaaaggttttcgcgcaagagaaattgtcggaggaagaggcggagttgctcgtggaagcagacgaggcgagggagaaatcggtcgttttgatgcgtgatccgtctggcatcatcaatcggggaaattggaccaggcaaaaggaattttggtcgatggtgaaccagcggatcgaaggatacttggtcaagcagattcgctcgcgcgttccattacaagatagtgcgtgtgaaaacacgggggatatttaa

SEQ ID NO: 34 - DNA, 3327 bp, Artificial Sequence
  Description of Artificial Sequence: Synthetic polynucleotide
atggcgacacgcagttttattttaaaaattgaaccaaatgaagaagttaaaaagggattatggaagacgcatgaggtattgaatcatggaattgcctactacatgaatattctgaaactaattagacaggaagctatttatgaacatcatgaacaagatcctaaaaatccgaaaaaagtttcaaaagcagaaatacaagccgagttatgggattttgttttaaaaatgcaaaaatgtaatagttttacacatgaagttgacaaagatgttgtttttaacatcctgcgtgaactatatgaagagttggtccctagttcagtcgagaaaaagggtgaagccaatcaattatcgaataagtttctgtacccgctagttgatccgaacagtcaaagtgggaaagggacggcatcatccggacgtaaacctcggtggtataatttaaaaatagcaggcgacccatcgtgggaggaagaaaagaaaaaatgggaagaggataaaaagaaagatccccttgctaaaatcttaggtaagttagcagaatatgggcttattccgctatttattccatttactgacagcaacgaaccaattgtaaaagaaattaaatggatggaaaaaagtcgtaatcaaagtgtccggcgacttgataaggatatgtttatccaagcattagagcgttttctttcatgggaaagctggaaccttaaagtaaaggaagagtatgaaaaagttgaaaaggaacacaaaacactagaggaaaggataaaagaggacattcaagcatttaaatcccttgaacaatatgaaaaagaacggcaggagcaacttcttagagatacattgaatacaaatgaataccgattaagcaaaagaggattacgtggttggcgtgaaattatccaaaaatggctaaagatggatgaaaatgaaccatcagaaaaatatttagaagtatttaaagattatcaacggaaacatccacgagaagccggggactattctgtctatgaatttttaagcaagaaagaaaatcattttatttggcgaaatcatcctgaatatccttatttgtatgctacattttgtgaaattgacaaaaaaaagaaagacgctaagcaacaggcaacttttactttggctgacccgattaaccatccgttatgggtacgatttgaagaaagaagcggttcgaacttaaacaaatatcgaattttaacagagcaattacacactgaaaagttaaaaaagaaattaacagttcaacttgatcgtttaatttatccaactgaatccggcggttgggaggaaaaaggtaaagtagatatcgttttgttgccgtcaagacaattttataatcaaatcttccttgatatagaagaaaaggggaaacatgcttttacttataaggatgaaagtattaaattcccccttaaaggtacacttggtggtgcaagagtgcagtttgaccgtgaccatttgcggagatatccgcataaagtagaatcaggaaatgttggacggatttattttaacatgacagtaaatattgaaccaactgagagccctgttagtaagtctttgaaaatacatagggacgatttccccaagttcgttaattttaaaccgaaagagctcaccgaatggataaaagatagtaaagggaaaaaattaaaaagtggtatagaatcccttgaaattggtctacgggtgatgagtatcgacttaggtcaacgtcaagcggctgctgcatcgatttttgaagtagttgatcagaaaccggatattgaagggaagttattttttccaatcaaaggaactgagctttatgctgttcaccgggcaagttttaacattaaattaccgggtgaaacattagtaaaatcacgggaagtattgcggaaagctcgggaggacaacttaaaattaatgaatcaaaagttaaactttctaagaaatgttctacatttccaacagtttgaagatatcacagaaagagagaagcgtgtaactaaatggatttctagacaagaaaatagtgatgttcctcttgtatatcaagatgagctaattcaaattcgtgaattaatgtataaaccctataaagattgggttgcctttttaaaacaactccataaacggctagaagtcgagattggcaaagaggttaagcattggcgaaaatcattaagtgacgggagaaaaggtctttacggaatctccctaaaaaatattgatgaaattgatcgaacaaggaaattccttttaagatggagcttacgtccaacagaacctggggaagtaagacgcttggaaccaggacagcgttttgcgattgatcaattaaaccacctaaatgcattaaaagaagatcgattaaaaaagatggcaaatacgattatcatgcatgccttaggttactgttatgatgtaagaaagaaaaagtggcaggcaaaaaatccagcatgtcaaattattttatttgaagatttatctaactacaatccttacgaggaaaggtcccgttttgaaaactcaaaactgatgaagtggtcacggagagaaattccacgacaagtcgccttacaaggtgaaatttacggattacaagttggggaagtaggtgcccaattcagttcaagattccatgcgaaaaccgggtcgccgggaattcgttgcagtgttgtaacgaaagaaaaattgcaggataatcgcttttttaaaaatttacaaagagaaggacgacttactcttgataaaatcgcagttttaaaagaaggagacttatatccagataaaggtggagaaaagtttatttctttatcaaaggatcgaaagttggtaactacgcatgctgatattaacgcggcccaaaatttacagaagcgtttttggacaagaacacatggattttataaagtttactgcaaagcctatcaggttgatggacaaactgtttatattccggagagcaaggaccaaaaacaaaaaataattgaagaatttggggaaggctattttattttaaaagatggtgtatatgaatggggtaatgcggggaaactaaaaattaaaaaaggttcctctaaacaatcatcgagtgaattagtagattcggacatactgaaagattcatttgatttagcaagtgaacttaagggagagaaactcatgttatatcgagatccgagtggaaacgtatttccttccgacaagtggatggcagcaggagtattttttggcaaattagaaagaatattgatttctaagttaacaaatcaatactcaatatcaacaatagaagatgattcttcaaaacaatcaatgtaa

SEQ ID NO: 35 - DNA, 3450 bp, Artificial Sequence
  Description of Artificial Sequence: Synthetic polynucleotide
atgcccacccgcaccatcaatctgaaacttgttcttgggaaaaatcctgaaaacgcaacattgcgacgcgccctattttcgacacaccgtttggttaaccaagcgacgaaacgtattgaggaattcttgttgctgtgtcgtggagaagcctacagaacagtggataatgaggggaaggaagccgagattccacgtcatgcagtccaagaagaagctcttgcctttgccaaagctgctcaacgccacaacggctgtatatccacctatgaagaccaagagattcttgatgtactgcggcaactgtacgaacgtcttgttccttcggtcaacgaaaacaacgaggcaggcgatgctcaagctgctaacgcctgggtcagtccgctcatgtcggcagaaagcgaaggaggcttgtcggtctacgacaaggtgcttgatccaccgccggtttggatgaagcttaaagaagaaaaggctccaggatgggaagccgcttctcaaatttggattcagagtgatgagggacagtcgttacttaataagccaggtagccctccccgctggattcgaaaactgcgatctgggcaaccgtggcaagatgatttcgtcagtgaccaaaagaaaaagcaagatgagctgaccaaagggaacgcaccacttataaaacaactcaaagaaatggggttgttgcctcttgttaacccattttttagacatcttcttgaccctgaaggtaaaggcgtgagtccatgggaccgtcttgctgtacgcgctgcagtggctcactttatctcctgggaaagttggaatcatagaacacgtgcagaatacaattccttgaaactacggcgagacgagtttgaggcagcatccgacgaattcaaagacgattttactttgctccgacaatatgaagccaaacgccatagtacattgaaaagcatcgcgctggccgacgattcgaacccttaccggattggagtacgttctctgcgtgcctggaaccgcgttcgtgaagaatggatagacaagggtgcaacagaagaacaacgcgtgaccatattgtcaaagcttcaaacacaacttcggggaaaattcggcgatcccgatctgttcaactggctagctcaggataggcatgtccatttgtggtctcctcgggacagcgtgacaccattggttcgcatcaatgcggtagataaagttctgcgtcgacgaaaaccgtatgcattgatgacctttgcccatccccgcttccaccctcgatggatactgtacgaggctccaggaggaagcaatctccgtcaatatgcattggattgtacagaaaacgctctacacatcacgttgcctttgcttgtcgacgatgcgcacggaacctggattgaaaaaaagatcagggtgccgctggcaccatccggacaaattcaagatttaactctggaaaaacttgagaagaaaaaaaatcgtttatactaccgttccggttttcagcagtttgccggcttggctggcggagctgaggttcttttccacagaccctatatggaacacgacgaacgcagcgaggagtctcttttggaacgtccgggagccgtttggttcaaattgaccctggatgtggcaacacaggctcccccgaactggcttgatggtaagggccgtgtccgtacaccgccggaggtacatcattttaaaaccgcattgtcgaataaaagcaaacatacacgtacgctgcagccgggtctccgtgtcttgtcagtagacttgggcatgcgaacattcgcctcctgctcagtatttgaactcatcgagggaaagcctgagacaggccgtgccttccctgttgccgatgagagatcaatggacagcccgaataaactgtgggccaagcatgaacgtagttttaaactgacgctccccggcgaaaccccttctcgaaaggaagaggaagagcgtagcatagcaagagcggaaatttatgcactgaaacgcgacatacaacgcctcaaaagcctactccgcttaggtgaagaagataacgataaccgtcgtgatgcattgcttgaacagttctttaaaggatggggagaagaagacgttgtgcctggacaagcgtttccacgctctcttttccaagggttgggagctgccccgtttcgctcaactccagagttatggcgtcagcattgccaaacatattatgacaaagcggaagcctgtctggctaaacatatcagtgattggcgcaagcgaactcgtccccgtccgacatcgcgggagatgtggtacaaaacacgttcctatcatggcggcaagtccatttggatgttggaatatcttgatgccgttcgaaaactgcttctcagttggagcttacgtggtcgtacttacggtgccattaatcgccaggatacagcccggtttggttctttggcatcacggctgctccaccatatcaattccctaaaggaagaccgcatcaaaacaggagccgactctatcgttcaggctgctcgcgggtatattcctctccctcatggcaagggttgggaacaaagatatgagccttgtcagctcatattatttgaagacctcgcacgatatcgctttcgcgtggatcgacctcgtcgagagaacagccaactcatgcagtggaaccatcgagccatcgtggcagaaacaacgatgcaagccgaactctacggacaaattgtcgaaaatactgcagcggggttcagcagtcgttttcacgcggcgacaggtgcccccggtgtacgttgtcgttttcttctagaaagagactttgataacgatttgcccaaaccgtaccttctcagggaactttcttggatgctcggcaatacaaaagtcgagtctgaagaagaaaagcttcgattgctgtctgaaaaaatcaggccaggcagtcttgttccttgggatggaggcgaacagttcgctaccctgcatcccaaaagacaaacactttgcgtcattcatgccgatatgaatgctgcccaaaatttacaacgccggtttttcggtcgatgcggcgaggcctttcggcttgtttgtcaaccccacggtgacgacgtgttacgactcgcatccaccccaggagctcgtcttcttggagccctgcagcagcttgaaaatggacaaggagctttcgagttggttcgagacatggggtcaacaagtcaaatgaaccggttcgtcatgaagtctttgggaaaaaagaaaataaaaccccttcaggacaacaatggagacgacgagcttgaagacgtgttgtccgtactcccggaggaagacgacacaggacgtatcacagtcttccgcgattcatcaggaatcttttttccttgcaacgtctggataccggccaaacagttttggccagcagtacgcgccatgatttggaaggtcatggcttcccattctttggggtga

SEQ ID NO: 36 - DNA, 3759 bp, Artificial Sequence
  Description of Artificial Sequence: Synthetic polynucleotide
atgacaaagttaagacaccgacagaaaaaattaacacacgactgggctggctccaaaaagagggaagtattaggctcaaatggcaagcttcagaatccgttgttaatgccggttaaaaaaggtcaggttactgagttccggaaagcgttttctgcgtatgctcgcgcaacgaaaggagaaatgactgacggccgaaagaatatgtttacgcatagtttcgagccatttaagacaaagccctcgcttcatcagtgtgaattggcagataaagcatatcaatctttacattcgtatctgcctggttctcttgctcattttctattatctgctcacgcattaggttttcgtattttttcaaaatctggtgaagcaactgcattccaggcatcctctaaaattgaagcttacgaatcaaaattggcaagcgaattagcttgtgtagatttatctattcaaaacttgactatttcaacgctttttaatgcgcttacaacgtctgtaagagggaagggcgaagaaactagcgctgaccccttaattgcacgattttacaccttacttactggcaagcctctgtctcgagacactcaagggcctgaacgtgatttagcagaagttatctcgcgtaagatagctagttcttttggcacatggaaagaaatgacggcaaaccctcttcagtcattacaattttttgaagaggaactccatgcgctggatgccaatgtctcgctctcacccgccttcgacgttttaattaaaatgaatgatttgcagggcgatttaaaaaatcgaaccattgtttttgatcctgacgcccctgtttttgaatataacgcagaagaccctgccgacataattattaaacttacagctcgttacgctaaagaagctgtcatcaaaaatcaaaacgtaggaaattacgttaaaaacgctattactaccacaaatgccaatggtcttggttggcttttgaacaaaggtttgtcgttactccctgtctcgaccgatgacgaattgctagagtttattggcgttgaacgatctcatccctcatgccatgccttaattgaattgattgcacaattagaagcccccgagctctttgagaagaacgtattttcagatactcgttctgaagttcaaggtatgattgattcagctgtttctaatcatattgctcgtctttccagctctagaaatagcttgtcaatggatagtgaagaattagaacgtttaatcaaaagctttcagatacacacacctcattgctcactttttattggcgcccaatcactttcacagcagttagaatctttgcctgaagcccttcaatcgggcgttaattcagccgatattttactaggctctactcaatatatgctcaccaattctttggttgaagagtcaattgcaacttatcaaagaacacttaatcgcatcaattacttgtcaggtgttgcaggtcagattaacggcgcaataaagcgaaaagcgatagatggagaaaaaattcacttgcctgcagcttggtcagagttgatatctttaccatttataggccagcctgttatagatgttgaaagcgatttagctcatctaaaaaatcaataccaaacactttcaaatgagtttgatactcttatatctgctttgcaaaagaattttgatttgaactttaataaagcgctccttaatcgtactcagcattttgaagccatgtgtagaagcactaagaaaaacgctttatccaaaccagagatcgtttcctatcgcgacctgcttgctcgattaacttcttgtttgtatcgaggctctttagttttgcgtcgtgccggcattgaagtgttaaaaaaacataaaatatttgagtcaaacagcgaacttcgtgaacatgttcatgaaagaaagcatttcgtgtttgttagtcctctagatcgcaaagccaagaaactccttcgattaactgattcgcgtccagacttgttacatgttattgatgaaatattgcagcacgataatcttgaaaacaaagaccgcgagtcactttggctagttcgctctggttatttgcttgcaggacttccagatcaactttcttcatcttttattaacttgcctatcattactcaaaaaggagatagacgccttatagacctgattcagtatgatcaaattaatcgtgatgcttttgttatgttagtgacctctgcattcaagtctaatttgtctggtctgcagtatcgtgccaataagcaatcgttcgttgttactcgcacgctaagcccttatctcggctcaaaacttgtctacgtacccaaggataaagattggttagttccttctcaaatgtttgaaggacgatttgctgacattcttcaatcagattatatggtctggaaagatgccggtcgtctttgtgttattgatactgcaaaacacctttctaatataaagaagtctgtattttcatccgaagaagttctcgcttttttaagagaactccctcaccgcacatttatccagaccgaagttcgcggccttggcgttaatgtcgatggaattgcatttaataatggtgatattccgtcattaaaaaccttttcaaattgcgttcaggtaaaagtttctcggactaatacatccctagttcaaacacttaatcgttggtttgaaggaggaaaagtttctcctccgagcattcaatttgaacgggcgtattataaaaaagacgatcaaattcatgaagacgcagcgaaaagaaagatacgattccagatgcccgcaactgagttggttcatgcttctgacgatgcggggtggacaccaagttatttgctcggcattgatcctggcgagtatggaatgggtctttcattggtttcgattaataacggagaagtcttagattcaggctttattcatattaattctctgatcaattttgcctctaaaaagagcaaccatcaaactaaggttgttccgcgtcagcagtacaaatctccttatgcaaattatttagaacaatctaaagattctgctgctggtgatattgcgcatatactcgatcgacttatatacaaattaaatgcgttgcctgtttttgaggctctttcaggtaattctcagagtgctgctgatcaagtttggacgaaagtcttatcgttttacacttggggtgataatgacgctcagaattctattagaaagcagcattggtttggagccagtcattgggatatcaaaggtatgttaaggcaaccccctacggagaagaagcctaaaccgtatattgcttttcctggctctcaggtttcttcgtatggtaattcccaacgttgctcttgctgcggtcgcaatcctattgaacaacttcgagaaatggcaaaggatacctctattaaagagctaaaaattcgcaattctgagatacagctttttgacggaaccattaaattatttaatccagacccatccactgtgatagagagaaggcgacataatcttggtccatcaagaattcctgttgctgaccgtactttcaaaaacatcagtccatcaagtctagaatttaaagaattgattactatcgtgtctcgatctatccgtcattcacctgagtttatcgctaaaaaacgcggcatagggtctgagtatttttgcgcttattccgattgcaactcatccttaaattctgaagctaacgcagctgctaacgtagcgcaaaaatttcaaaaacagttattttttgagttataa

SEQ ID NO: 37 - DNA, 3864 bp, Artificial Sequence
  Description of Artificial Sequence: Synthetic polynucleotide
atgaagagaattctgaacagtctgaaagttgctgccttgagacttctgtttcgaggcaaaggttctgaattagtgaagacagtcaaatatccattggtttccccggttcaaggcgcggttgaagaacttgctgaagcaattcggcacgacaacctgcacctttttgggcagaaggaaatagtggatcttatggagaaagacgaaggaacccaggtgtattcggttgtggatttttggttggataccctgcgtttagggatgtttttctcaccatcagcgaatgcgttgaaaatcacgctgggaaaattcaattctgatcaggtttcaccttttcgtaaggttttggagcagtcacctttttttcttgcgggtcgcttgaaggttgaacctgcggaaaggatactttctgttgaaatcagaaagattggtaaaagagaaaacagagttgagaactatgccgccgatgtggagacatgcttcattggtcagctttcttcagatgagaaacagagtatccagaagctggcaaatgatatctgggatagcaaggatcatgaggaacagagaatgttgaaggcggatttttttgctatacctcttataaaagaccccaaagctgtcacagaagaagatcctgaaaatgaaacggcgggaaaacagaaaccgcttgaattatgtgtttgtcttgttcctgagttgtatacccgaggtttcggctccattgctgattttctggttcagcgacttaccttgctgcgtgacaaaatgagtaccgacacggcggaagattgcctcgagtatgttggcattgaggaagaaaaaggcaatggaatgaattccttgctcggcacttttttgaagaacctgcagggtgatggttttgaacagatttttcagtttatgcttgggtcttatgttggctggcaggggaaggaagatgtactgcgcgaacgattggatttgctggccgaaaaagtcaaaagattaccaaagccaaaatttgccggagaatggagtggtcatcgtatgtttctccatggtcagctgaaaagctggtcgtcgaatttcttccgtctttttaatgagacgcgggaacttctggaaagtatcaagagtgatattcaacatgccaccatgctcattagctatgtggaagagaaaggaggctatcatccacagctgttgagtcagtatcggaagttaatggaacaattaccggcgttgcggactaaggttttggatcctgagattgagatgacgcatatgtccgaggctgttcgaagttacattatgatacacaagtctgtagcgggatttctgccggatttactcgagtctttggatcgagataaggatagggaatttttgctttccatctttcctcgtattccaaagatagataagaagacgaaagagatcgttgcatgggagctaccgggcgagccagaggaaggctatttgttcacagcaaacaaccttttccggaattttcttgagaatccgaaacatgtgccacgatttatggcagagaggattcccgaggattggacgcgtttgcgctcggcccctgtgtggtttgatgggatggtgaagcaatggcagaaggtggtgaatcagttggttgaatctccaggcgccctttatcagttcaatgaaagttttttgcgtcaaagactgcaagcaatgcttacggtctataagcgggatctccagactgagaagtttctgaagctgctggctgatgtctgtcgtccactcgttgattttttcggacttggaggaaatgatattatcttcaagtcatgtcaggatccaagaaagcaatggcagactgttattccactcagtgtcccagcggatgtttatacagcatgtgaaggcttggctattcgtctccgcgaaactcttggattcgaatggaaaaatctgaaaggacacgagcgggaagattttttacggctgcatcagttgctgggaaatctgctgttctggatcagggatgcgaaacttgtcgtgaagctggaagactggatgaacaatccttgtgttcaggagtatgtggaagcacgaaaagccattgatcttcccttggagattttcggatttgaggtgccgatttttctcaatggctatctcttttcggaactgcgccagctggaattgttgctgaggcgtaagtcggtgatgacgtcttacagcgtcaaaacgacaggctcgccaaataggctcttccagttggtttacctacctctaaacccttcagatccggaaaagaaaaattccaacaactttcaggagcgcctcgatacacctaccggtttgtcgcgtcgttttctggatcttacgctggatgcatttgctggcaaactcttgacggatccggtaactcaggaactgaagacgatggccggtttttacgatcatctctttggcttcaagttgccgtgtaaactggcggcgatgagtaaccatccaggatcctcttccaaaatggtggttctggcaaaaccaaagaagggtgttgctagtaacatcggctttgaacctattcccgatcctgctcatcctgtgttccgggtgagaagttcctggccggagttgaagtacctggaggggttgttgtatcttcccgaagatacaccactgaccattgaactggcggaaacgtcggtcagttgtcagtctgtgagttcagtcgctttcgatttgaagaatctgacgactatcttgggtcgtgttggtgaattcagggtgacggcagatcaacctttcaagctgacgcccattattcctgagaaagaggaatccttcatcgggaagacctacctcggtcttgatgctggagagcgatctggcgttggtttcgcgattgtgacggttgacggcgatgggtatgaggtgcagaggttgggtgtgcatgaagatactcagcttatggcgcttcagcaagtcgccagcaagtctcttaaggagccggttttccagccactccgtaagggcacatttcgtcagcaggagcgcattcgcaaaagcctccgcggttgctactggaatttctatcatgcattgatgatcaagtaccgagctaaagttgtgcatgaggaatcggtgggttcatccggtctggtggggcagtggctgcgtgcatttcagaaggatctcaaaaaggctgatgttctgcccaagaagggtggaaaaaatggtgtagacaaaaaaaagagagaaagcagcgctcaggataccttatggggaggagctttctcgaagaaggaagagcagcagatagcctttgaggttcaggcagctggatcaagccagttttgtctgaagtgtggttggtggtttcagttggggatgcgggaagtaaatcgtgtgcaggagagtggcgtggtgctggactggaaccggtccattgtaaccttcctcatcgaatcctcaggagaaaaggtatatggtttcagtcctcagcaactggaaaaaggctttcgtcctgacatcgaaacgttcaaaaaaatggtaagggattttatgagaccccccatgtttgatcgcaaaggtcggccggccgcggcgtatgaaagattcgtactgggacgtcgtcaccgtcgttatcgctttgataaagtttttgaagagagatttggtcgcagtgctcttttcatctgcccgcgggtcgggtgtgggaatttcgatcactccagtgagcagtcagccgttgtccttgcccttattggttacattgctgataaggaagggatgagtggtaagaagcttgtttatgtgaggctggctgaacttatggctgagtggaagctgaagaaactggagagatcaagggtggaagaacagagctcggcacaataa

SEQ ID NO: 38 - DNA, 3579 bp, Artificial Sequence
  Description of Artificial Sequence: Synthetic polynucleotide
atggcagaaagcaagcagatgcaatgccgcaagtgcggcgcaagcatgaagtatgaagtaattggattgggcaagaagtcatgcagatatatgtgcccagattgcggcaatcacaccagcgcgcgcaagattcagaacaagaaaaagcgcgacaaaaagtatggatccgcaagcaaagcgcagagccagaggatagctgtggctggcgcgctttatccagacaaaaaagtgcagaccataaagacctacaaatacccagcggatcttaatggcgaagttcatgacagcggcgtcgcagagaagattgcgcaggcgattcaggaagatgagatcggcctgcttggcccgtccagcgaatacgcttgctggattgcttcacaaaaacagagcgagccgtattcagttgtagatttttggtttgacgcggtgtgcgcaggcggagtattcgcgtattctggcgcgcgcctgctttccacagtcctccagttgagtggcgaggaaagcgttttgcgcgctgctttagcatctagcccgtttgtagatgacattaatttggcgcaagcggaaaagttcctagccgttagccggcgcacaggccaagataagctaggcaagcgcattggagaatgttttgcggaaggccggcttgaagcgcttggcatcaaagatcgcatgcgcgaattcgtgcaagcgattgatgtggcccaaaccgcgggccagcggttcgcggccaagctaaagatattcggcatcagtcagatgcctgaagccaagcaatggaacaatgattccgggctcactgtatgtattttgccggattattatgtcccggaagaaaaccgcgcggaccagctggttgttttgcttcggcgcttacgcgagatcgcgtattgcatgggaattgaggatgaagcaggatttgagcatctaggcattgaccctggtgctctttccaatttttccaatggcaatccaaagcgaggatttctcggccgcctgctcaataatgacattatagcgctggcaaacaacatgtcagccatgacgccgtattgggaaggcagaaaaggcgagttgattgagcgccttgcatggcttaaacatcgcgctgaaggattgtatttgaaagagccacatttcggcaactcctgggcagaccaccgcagcaggattttcagtcgcattgcgggctggctttccggatgcgcgggcaagctcaagattgccaaggatcagatttcaggcgtgcgtacggatttgtttctgctcaagcgccttctggatgcggtaccgcaaagcgcgccgtcgccggactttattgcttccatcagcgcgctggatcggtttttggaagcggcagaaagcagccaggatccggcagaacaggtacgcgctttgtacgcgtttcatctgaacgcgcctgcggtccgatccatcgccaacaaggcggtacagaggtctgattcccaggagtggcttatcaaggaactggatgctgtagatcaccttgaattcaacaaagcatttccgtttttttcggatacaggaaagaaaaagaagaaaggagcgaatagcaacggagcgccttctgaagaagaatacacggaaacagaatccattcaacaaccagaagatgcagagcaggaagtgaatggtcaagaaggaaatggcgcttcaaagaaccagaaaaagtttcagcgcattcctcgatttttcggggaagggtcaaggagtgagtatcgaattttaacagaagcgccgcaatattttgacatgttctgcaataatatgcgcgcgatctttatgcagctagagagtcagccgcgcaaggcgcctcgtgatttcaaatgctttctgcagaatcgtttgcagaagctttacaagcaaacctttctcaatgctcgcagtaataaatgccgcgcgcttctggaatccgtccttatttcatggggagaattttatacttatggcgcgaatgaaaagaagtttcgtctgcgccatgaagcgagcgagcgcagctcggatccggactatgtggttcagcaggcattggaaatcgcgcgccggcttttcttgttcggatttgagtggcgcgattgctctgctggagagcgcgtggatttggttgaaatccacaaaaaagcaatctcatttttgcttgcaatcactcaggccgaggtttcagttggttcctataactggcttgggaatagcaccgtgagccggtatctttcggttgctggcacagacacattgtacggcactcaactggaggagtttttgaacgccacagtgctttcacagatgcgtgggctggcgattcggctttcatctcaggagttaaaagacggatttgatgttcagttggagagttcgtgccaggacaatctccagcatctgctggtgtatcgcgcttcgcgcgacttggctgcgtgcaaacgcgctacatgcccggctgaattggatccgaaaattcttgttctgccggttggtgcgtttatcgcgagcgtaatgaaaatgattgagcgtggcgatgaaccattagcaggcgcgtatttgcgtcatcggccgcattcattcggctggcagatacgggttcgtggagtggcggaagtaggcatggatcagggcacagcgctagcattccagaagccgactgaatcagagccgtttaaaataaagccgttttccgctcaatacggcccagtactttggcttaattcttcatcctatagccagagccagtatctggatggatttttaagccagccaaagaattggtctatgcgggtgctacctcaagccggatcagtgcgcgtggaacagcgcgttgctctgatatggaatttgcaggcaggcaagatgcggctggagcgctctggagcgcgcgcgtttttcatgccagtgccattcagcttcaggccgtctggttcaggagatgaagcagtattggcgccgaatcggtacttgggactttttccgcattccggaggaatagaatacgcggtggtggatgtattagattccgcgggtttcaaaattcttgagcgcggtacgattgcggtaaatggcttttcccagaagcgcggcgaacgccaagaggaggcacacagagaaaaacagagacgcggaatttctgatataggccgcaagaagccggtgcaagctgaagttgacgcagccaatgaattgcaccgcaaatacaccgatgttgccactcgtttagggtgcagaattgtggttcagtgggcgccccagccaaagccgggcacagcgccgaccgcgcaaacagtatacgcgcgcgcagtgcggaccgaagcgccgcgatctggaaatcaagaggatcatgctcgtatgaaatcctcttggggatatacctggggcacctattgggagaagcgcaaaccagaggatattttgggcatctcaacccaagtatactggaccggcggtataggcgagtcatgtcccgcagtcgcggttgcgcttttggggcacattagggcaacatccactcaaactgaatgggaaaaagaggaggttgtattcggtcgactgaagaagttctttccaagctag

SEQ ID NO: 39 - DNA, 2958 bp, Artificial Sequence
  Description of Artificial Sequence: Synthetic polynucleotide
atggaaaagagaataaacaagatacgaaagaaactatcggccgataatgccacaaagcctgtgagcaggagcggccccatgaaaacactccttgtccgggtcatgacggacgacttgaaaaaaagactggagaagcgtcggaaaaagccggaagttatgccgcaggttatttcaaataacgcagcaaacaatcttagaatgctccttgatgactatacaaagatgaaggaggcgatactacaagtttactggcaggaatttaaggacgaccatgtgggcttgatgtgcaaatttgcccagcctgcttccaaaaaaattgaccagaacaaactaaaaccggaaatggatgaaaaaggaaatctaacaactgccggttttgcatgttctcaatgcggtcagccgctatttgtttataagcttgaacaggtgagtgaaaaaggcaaggcttatacaaattacttcggccggtgtaatgtggccgagcatgagaaattgattcttcttgctcaattaaaacctgaaaaagacagtgacgaagcagtgacatactcccttggcaaattcggccagagggcattggacttttattcaatccacgtaacaaaagaatccacccatccagtaaagcccctggcacagattgcgggcaaccgctatgcaagcggacctgttggcaaggccctttccgatgcctgtatgggcactatagccagttttctttcgaaatatcaagacatcatcatagaacatcaaaaggttgtgaagggtaatcaaaagaggttagagagtctcagggaattggcagggaaagaaaatcttgagtacccatcggttacactgccgccgcagccgcatacgaaagaaggggttgacgcttataacgaagttattgcaagggtacgtatgtgggttaatcttaatctgtggcaaaagctgaagctcagccgtgatgacgcaaaaccgctactgcggctaaaaggattcccatctttccctgttgtggagcggcgtgaaaacgaagttgactggtggaatacgattaatgaagtaaaaaaactgattgacgctaaacgagatatgggacgggtattctggagcggcgttaccgcagaaaagagaaataccatccttgaaggatacaactatctgccaaatgagaatgaccataaaaagagagagggcagtttggaaaaccctaagaagcctgccaaacgccagtttggagacctcttgctgtatcttgaaaagaaatatgccggagactggggaaaggtcttcgatgaggcatgggagaggatagataagaaaatagccggactcacaagccatatagagcgcgaagaagcaagaaacgcggaagacgctcaatccaaagccgtacttacagactggctaagggcaaaggcatcatttgttcttgaaagactgaaggaaatggatgaaaaggaattctatgcgtgtgaaatccaacttcaaaaatggtatggcgatcttcgaggcaacccgtttgccgttgaagctgagaatagagttgttgatataagcgggttttctatcggaagcgatggccattcaatccaatacagaaatctccttgcctggaaatatctggagaacggcaagcgtgaattctatctgttaatgaattatggcaagaaagggcgcatcagatttacagatggaacagatattaaaaagagcggcaaatggcagggactattatatggcggtggcaaggcaaaggttattgatctgactttcgaccccgatgatgaacagttgataatcctgccgctggcctttggcacaaggcaaggccgcgagtttatctggaacgatttgctgagtcttgaaacaggcctgataaagctcgcaaacggaagagttatcgaaaaaacaatctataacaaaaaaatagggcgggatgaaccggctctattcgttgccttaacatttgagcgccgggaagttgttgatccatcaaatataaagcctgtaaaccttataggcgttgaccgcggcgaaaacatcccggcggttattgcattgacagaccctgaaggttgtcctttaccggaattcaaggattcatcagggggcccaacagacatcctgcgaataggagaaggatataaggaaaagcagagggctattcaggcagcaaaggaggtagagcaaaggcgggctggcggttattcacggaagtttgcatccaagtcgaggaacctggcggacgacatggtgagaaattcagcgcgagaccttttttaccatgccgttacccacgatgccgtccttgtctttgaaaacctgagcaggggttttggaaggcagggcaaaaggaccttcatgacggaaagacaatatacaaagatggaagactggctgacagcgaagctcgcatacgaaggtcttacgtcaaaaacctacctttcaaagacgctggcgcaatatacgtcaaaaacatgctccaactgcgggtttactataacgactgccgattatgacgggatgttggtaaggcttaaaaagacttctgatggatgggcaactaccctcaacaacaaagaattaaaagccgaaggccagataacgtattataaccggtataaaaggcaaaccgtggaaaaagaactctccgcagagcttgacaggctttcagaagagtcgggcaataatgatatttctaagtggaccaagggtcgccgggacgaggcattatttttgttaaagaaaagattcagccatcggcctgttcaggaacagtttgtttgcctcgattgcggccatgaagtccacgccgatgaacaggcagccttgaatattgcaaggtcatggctttttctaaactcaaattcaacagaattcaaaagttataaatcgggtaaacagcccttcgttggtgcttggcaggccttttacaaaaggaggcttaaagaggtatggaagcccaacgcc

SEQ ID NO: 40 - DNA, 2919 bp, Artificial Sequence
  Description of Artificial Sequence: Synthetic polynucleotide
atgaaaaggataaataaaatacgaaggagattggtaaaggatagcaacacgaaaaaagccggcaaaaccggccctatgaaaaccttgctcgttcgggttatgacacctgacctgagagaaaggttagagaatcttcgcaaaaagccggaaaacattcctcagcccatttcaaatacttcacgtgcaaatttaaataaactcctcactgactatacggaaatgaagaaagcaatcctgcatgtttattgggaagagttccaaaaagaccctgtcggattgatgagcagggttgcacaaccagcgcccaagaatattgatcagagaaaattgattccggtgaaggacggaaatgagagactaacaagttctggatttgcctgttctcagtgctgtcaacccctctatgtttataagcttgaacaagtgaatgacaagggtaagccccatacaaattactttggccgttgtaatgtctccgagcatgaacgtttgatattgctctcgccgcataaaccggaggcaaatgacgagctagtaacgtattcgttggggaagttcggtcaaagggcattggacttttattcaatccacgtaacaagagaatcgaaccatcctgtaaagccgctagaacagatcggtggcaatagctgcgcaagtggtcccgttggtaaggctttatctgatgcctgtatgggagcagtagccagtttccttacaaagtaccaggacatcatcctcgaacaccaaaaggttataaaaaaaaacgaaaagagattggcaaatctaaaggatatagcaagtgcaaacgggcttgcatttcctaaaatcactcttccaccgcaaccgcatacaaaagaagggattgaagcttataacaatgttgttgctcagatagtgatctgggtaaacctgaatctttggcagaaactcaaaattggcagggatgaggcaaagcccttacagcggcttaagggttttccgtccttccctcttgttgaacgccaggcgaatgaggttgattggtgggatatggtctgtaatgtcaaaaagttgattaacgaaaagaaagaggacgggaaggtcttctggcaaaatcttgctggatataaaaggcaggaagccttgcttccatatctttcgtctgaagaagaccgtaaaaaaggaaaaaagtttgcgcgttatcagtttggtgaccttttgcttcaccttgaaaagaaacacggtgaagattggggcaaagtttatgatgaggcatgggaaagaatagataaaaaagttgaaggtctgagtaagcacataaagttggaggaagaaagaaggtctgaagatgctcaatcaaaggctgccctcactgattggctcagggcaaaggcctcttttgttattgaagggctcaaagaagctgataaggatgagttttgcaggtgtgagttaaagcttcaaaagtggtatggagatttgagaggaaaaccatttgctatagaagcagagaacagcattttagatataagcggattttctaaacagtataattgtgcatttatatggcagaaagacggcgtaaagaagttaaatctttatttaataataaattacttcaaaggtggtaagctacgcttcaaaaaaatcaagccagaagcttttgaagcaaataggttttatacagtaattaataaaaaaagcggtgagattgtgcctatggaggtcaacttcaattttgatgacccgaatttgataattctgcctttggcctttggaaaaaggcaggggagggagtttatctggaacgacctattgagccttgagacgggttcattgaaactcgccaatggcagggttattgaaaaaacgctctataacagaaggacgagacaggatgaaccagcactttttgttgccctgacatttgaaagaagagaggtgcttgactcatcgaatataaaaccgatgaatctgataggaatagaccggggagaaaatatcccggcagtcatagcattaacagacccggaaggatgccccttgtcaagattcaaagattcattgggcaatccaacgcatattttgcgaataggagaaagttataaggaaaaacaacggactattcaggctgctaaagaagttgaacaaaggcgggcaggcggatattcgagaaaatatgcatcaaaggcgaagaatctggcggacgatatggtaagaaatacagctcgtgacctcttatattatgctgttactcaagatgcaatgctcatttttgaaaatctttcccgcggttttggtagacaaggcaagaggacttttatggcggaaaggcagtacacgaggatggaagactggctgactgcaaagcttgcctatgaaggtctgccatcaaaaacctatctttcaaagactctggcacagtatacctcaaagacatgttctaattgtggttttacaatcacaagtgcagattatgacagggtgctcgaaaagctcaagaagacggctactggatggatgactacaatcaatggaaaagagttaaaagttgaaggacagataacatactataaccggtataaaaggcagaatgtggtaaaagacctctctgtagagctggatagactttcggaagagtcggtaaataatgatatttctagttggacaaaaggccgcagtggtgaagctttatctctgctaaaaaagagatttagtcacaggccggtgcaggaaaagtttgtttgcctgaactgtggttttgaaacccatgcagacgaacaagcagcactgaatattgcaaggtcgtggctctttctccgttctcaagaatataagaagtatcaaaccaataaaacgaccggaaatactgacaaaagggcatttgttgaaacatggcaatccttttacagaaagaagctcaaagaagtatggaaacca

SEQ ID NO: 41 - DNA, 4077 bp, Artificial Sequence
  Description of Artificial Sequence: Synthetic polynucleotide
atgggtaaaatgtattaccttggtttagacattggcacgaattccgtgggctacgcggtgaccgacccctcataccacctgctgaagtttaagggggaaccaatgtggggtgcgcacgtatttgccgccggtaatcagagcgcggaacgacgctcgttccgcacatcgcgtcgtcgtttggaccgacgccaacagcgcgttaaactggtacaggagatttttgccccggtgattagtccgatcgacccacgcttcttcattcgtctgcatgaatccgccctgtggcgcgatgacgtcgcggagacggataaacatatctttttcaatgatcctacctataccgataaggaatattatagcgattacccgactatccatcacctgatcgttgatctgatggaaagctctgagaaacacgatccgcggctggtgtaccttgcagtggcgtggttagtggcacaccgtggtcattttctgaacgaggtggacaaggataatattggagatgtgttgtcgttcgacgcattttatccggagtttctcgcgttcctgtcggacaacggtgtatcaccgtgggtgtgcgaaagcaaagcgctgcaggcgaccttgctgagccgtaactcagtgaacgacaaatataaagcccttaagtctctgatcttcggatcccagaaacctgaagataacttcgatgccaatatttcggaagatggactcattcaactgctggccggcaaaaaggtaaaagttaacaaactgttccctcaggaatcgaacgatgcatccttcacattgaatgataaagaagacgcgatagaagaaatcctgggtacgcttacaccagatgaatgtgaatggattgcgcatatacgccgcctttttgactgggctatcatgaaacatgctctgaaagatggcaggactattagcgagtcaaaagtcaaactgtatgagcagcaccatcacgatctgacccaacttaaatacttcgtgaaaacctaccttgcaaaagaatacgacgatattttccgcaacgtggatagcgaaacaacgaaaaactatgtagcgtattcctatcatgtgaaagaggtgaaaggcactctgcctaaaaataaggcaacgcaagaagagttttgtaagtatgtcctgggcaaggttaaaaacattgaatgctctgaagcagacaaggttgactttgatgagatgattcagcgtcttaccgacaactcttttatgcctaagcaggtttcgggcgaaaaccgcgttattccttatcagttatattattatgaactgaagacaattctgaataaagcagcctcgtacctgcctttcctgacgcagtgtggaaaagatgcaatttcgaaccaggacaaactactgtcgatcatgacgttccgtattccttacttcgtcggacccttgcgaaaagataattcggaacatgcatggctcgaacgaaaggccggtaagatttatccgtggaactttaacgacaaagtggacttggataaatcagaagaagcgttcattcgccgaatgaccaatacctgtacctattatcccggcgaagatgttttaccgttggattcgctgatctatgagaaatttatgattttaaatgaaatcaataatattcgtattgacggctacccgattagtgttgacgttaaacagcaggtttttggcttgttcgaaaaaaaacgacgcgtaaccgtgaaagatattcagaacctgctgctgtctctcggagctctggacaaacacgggaagctgacaggcatcgataccactatccactcaaactataatacgtatcaccattttaaatctctcatggaacgcggcgtcctgacccgggatgacgtggaacgcatcgttgaaaggatgacctacagcgacgatactaagcgtgtgcgtctgtggctgaataacaactatggtactttaaccgccgacgatgtgaaacacatttcgcgtctgcgcaaacacgattttggccgtttatccaaaatgttcttaacaggtctgaagggtgtccataaggagaccggtgaacgtgcctccatactggatttcatgtggaacacgaacgataacctgatgcagctcctttccgaatgctacacgttcagtgatgaaatcacaaagctgcaagaggcgtattatgcaaaagcccagttgtctttaaacgattttttagactcgatgtacatctctaacgcggtgaaacgtccgatttacagaactctggcagtggtgaacgatattcgaaaagcatgtgggacggcccctaaacgcattttcatcgaaatggctcgtgatggtgaatcaaaaaaaaagagaagtgttacacgtcgcgagcagatcaaaaacctgtaccgctcgattcgtaaagatttccagcaggaagttgattttctggaaaagatcctggaaaataaatctgatggtcaacttcagtcagatgctttgtatctttactttgcacaattagggcgcgatatgtacacgggcgatccaataaagctggagcacatcaaagatcagagtttctataacatagaccatatttacccgcagtctatggtgaaagacgattccctagataacaaagtgctggtgcaaagcgaaattaacggcgagaaaagctcgcgataccctttggacgccgcgatccgcaataaaatgaagcccctttgggacgcttactataatcatggcctgatctccttaaagaaataccagcgtctaacgcgctcgaccccgtttaccgatgatgaaaaatgggactttattaatcgccagttagtggaaacccgtcaatctaccaaagcgctggccattttgttgaagcgtaagtttccagacaccgaaattgtgtattcgaaggcggggttatcgtccgacttcagacatgaattcggccttgtaaaaagtcgcaatattaatgatttgcaccacgctaaagacgcattcttggctatcgttaccggcaatgtgtaccatgaaagattcaatcgcagatggtttatggtgaaccagccgtactcagttaaaactaaaactctttttacccacagcataaagaatggcaacttcgttgcctggaacggcgaagaagatctcggtcgtattgtaaaaatgctgaagcaaaacaaaaataccattcacttcacgcgcttctccttcgatcgcaaagaaggattatttgatatccaacctctgaaagccagcaccggcttagtcccacgaaaagccggtctggatgtcgttaaatacggcggatatgacaaatctaccgcggcctattacctgctggtgaggttcacgctcgaggacaagaaaacccagcacaagctgatgatgattcctgtagaaggcctgtacaaggctcgcattgatcatgacaaggaatttcttaccgattatgcgcaaacgactataagcgaaatcctacagaaagataaacagaaagtgatcaatattatgtttccaatgggtacgaggcatataaaactcaattcaatgattagtatcgatggcttctatcttagtatcggcggaaagtcctctaaaggtaagtcagttctatgtcacgcaatggttccactgatcgtccctcacaaaatcgaatgttacattaaagcaatggaaagcttcgcccggaagtttaaagaaaacaacaagctgcgcatcgtagaaaaattcgataaaatcaccgttgaagacaacctgaatctctacgagctctttctccaaaaactgcagcataatccctataataagtttttttcgacacagtttgacgtactgacgaacggccgttctactttcacaaaactgtcgccggaggaacaggtacagacgctcttgaacattttaagtatctttaaaacatgccgcagttcgggttgcgacctgaaatccatcaacggcagtgcccaggcagcgcgcatcatgattagcgctgacttaactggactgtcgaaaaaatattcagatattaggttggttgaacagtcagcttctggtttgttcgtatccaaaagtcagaacttactggagtatctctaa

SEQ ID NO: 42 - DNA, 4005 bp, Artificial Sequence
  Description of Artificial Sequence: Synthetic polynucleotide
atgtcatcgctcacgaaattcactaacaaatactctaaacagctcaccattaagaatgaactcatcccagttggcaaaacactggagaacatcaaagagaatggtctgatagatggcgacgaacagctgaatgagaattatcagaaggcgaaaattattgtggatgattttctgcgggacttcattaataaagcactgaataatacgcagatcgggaactggcgcgaactggcggatgcccttaataaagaggatgaagataacatcgagaaattgcaggataaaattcggggaatcattgtatccaaatttgaaacgtttgatctgtttagcagctattctattaagaaagatgaaaagattattgacgacgacaatgatgttgaagaagaggaactggatctgggcaagaagaccagctcatttaaatacatatttaaaaaaaacctgtttaagttagtgttgccatcctacctgaaaaccacaaaccaggacaagctgaagattattagctcgtttgataatttttcaacgtacttccgcgggttctttgaaaaccggaaaaacatttttaccaagaaaccgatctccacaagtattgcgtatcgcattgttcatgataacttcccgaaattccttgataacattcgttgttttaatgtgtggcagacggaatgcccgcaactaatcgtgaaagcagataactatctgaaaagcaaaaatgttatagcgaaagataaaagtttggcaaactattttaccgtgggcgcgtatgactatttcctgtctcagaatggtatagatttttacaacaatattataggtggactgccagcgttcgccggccatgagaaaatccaaggtctcaatgaattcatcaatcaagagtgccaaaaagacagcgagctgaaaagtaagctgaaaaaccgtcacgcgttcaaaatggcggtactgttcaaacagatactcagcgatcgtgaaaaaagttttgtaattgatgagttcgagtcggatgctcaagttattgacgccgttaaaaacttttacgccgaacagtgcaaagataacaatgttatttttaacttattaaatcttatcaagaatatcgctttcttaagtgatgacgaactggacggcatattcattgaagggaaatacctgtcgagcgttagtcaaaaactctatagcgattggtcaaaattacgtaacgacattgaggattcggctaactctaaacaaggcaataaagagctggccaagaagatcaaaaccaacaaaggggatgtagaaaaagcgatctcgaaatatgagttctcgctgtcggaactgaactcgattgtacatgataacaccaagttttctgacctccttagttgtacactgcataaggtggcttctgagaaactggtgaaggtcaatgaaggcgactggccgaaacatctcaagaataatgaagagaaacaaaaaatcaaagagccgcttgatgctctgctggagatctataatacacttctgatttttaactgcaaaagcttcaataaaaacggcaacttctatgtcgactatgatcgttgcatcaatgaactgagttcggtcgtgtatctgtataataaaacacgtaactattgcactaaaaaaccctataacacggacaagttcaaactcaattttaacagtccgcagctcggtgaaggcttttccaagtcgaaagaaaatgactgtctgactcttttgtttaaaaaagacgacaactattatgtaggcattatccgcaaaggtgcaaaaatcaattttgatgatacacaagcaatcgccgataacaccgacaattgcatctttaaaatgaattatttcctacttaaagacgcaaaaaaatttatcccgaaatgtagcattcagctgaaagaagtcaaggcccattttaagaaatctgaagatgattacattttgtctgataaagagaaatttgctagcccgctggtcattaaaaagagcacatttttgctggcaactgcacatgtgaaagggaaaaaaggcaatatcaagaaatttcagaaagaatattcgaaagaaaaccccactgagtatcgcaattctttaaacgaatggattgctttttgtaaagagttcttaaaaacttataaagcggctaccatttttgatataaccacattgaaaaaggcagaggaatatgctgatattgtagaattctacaaggatgtcgataatctgtgctacaaactggagttctgcccgattaaaacctcgtttatagaaaacctgatagataacggcgacctgtatctgtttcgcatcaataacaaagacttcagcagtaaatcgaccggcaccaagaaccttcatacgttatatttacaagctatattcgatgaacgtaatctgaacaatccgacaattatgctgaatgggggagcagaactgttctatcgtaaagaaagtattgagcagaaaaaccgtatcacacacaaagccggttcaattctcgtgaataaggtgtgtaaagacggtacaagcctggatgataagatacgtaatgaaatttatcaatatgagaataaatttattgataccctgtctgatgaagctaaaaaggtgttaccgaatgtcattaaaaaggaagctacccatgacattacaaaagataaacgtttcactagtgacaaattcttctttcactgccccctgacaattaattataaggaaggcgataccaagcagttcaataacgaagtgctgagttttctgcgtggaaatcctgacatcaacattatcggcattgaccgcggagagcgtaatttaatctatgtaacggttataaaccagaaaggcgagattctggattcggtttcattcaataccgtgaccaacaagagttcaaaaatcgagcagacagtcgattatgaagagaaattggcagtccgcgagaaagagaggattgaagcaaaacgttcctgggactctatctcaaaaattgcgacactaaaggaaggttatctgagcgcaatagttcacgagatctgtctgttaatgattaaacacaacgcgatcgttgtcttagagaatcttaatgcaggctttaagcgtattcgtggcggtttatcagaaaaaagtgtttatcaaaaattcgaaaaaatgttgattaacaaactgaactattttgtcagcaagaaggaatccgactggaataaaccgtctggtctgctgaatggactgcagctttcggatcagtttgaaagcttcgaaaaactgggtattcagtctggttttattttttacgtgccggctgcatatacctcaaagattgatccgaccacgggcttcgccaatgttctgaatctgtcgaaggtacgcaatgttgatgcgatcaaaagctttttttctaacttcaacgaaattagttatagcaagaaagaagcccttttcaaattctcattcgatctggattcactgagtaagaaaggctttagtagctttgtgaaatttagtaagagtaaatggaacgtctacacctttggagaacgtatcataaagccaaagaataagcaaggttatcgggaggacaaaagaatcaacttgaccttcgagatgaagaagttacttaacgagtataaggtttcttttgatcttgaaaataacttgattccgaatctcacgagtgccaacctgaaggatactttttggaaagagctattctttatcttcaagactacgctgcagctccgtaacagcgttactaacggtaaagaagatgtgctcatctctccggtcaaaaatgcgaagggtgaattcttcgtttcgggaacgcataacaagactcttccgcaagattgcgatgcgaacggtgcataccatattgcgttgaaaggtctgatgatactcgaacgtaacaaccttgtacgtgaggagaaagatacgaaaaagattatggcgatttcaaacgtggattggttcgagtacgtgcagaaacgtagaggcgttctgtaa

SEQ ID NO: 43 - DNA, 3717 bp, Artificial Sequence
  Description of Artificial Sequence: Synthetic polynucleotide
atgaacaactacgacgaattcaccaaactgtacccgatccagaaaaccatccgtttcgaactgaaaccgcagggtcgtaccatggaacacctggaaaccttcaacttcttcgaagaagaccgtgaccgtgcggaaaaatacaaaatcctgaaagaagcgatcgacgaataccacaaaaaattcatcgacgaacacctgaccaacatgtctctggactggaactctctgaaacagatctctgaaaaatactacaaatctcgtgaagaaaaagacaaaaaagttttcctgtctgaacagaaacgtatgcgtcaggaaatcgtttctgaattcaaaaaagacgaccgtttcaaagacctgttctctaaaaaactgttctctgaactgctgaaagaagaaatctacaaaaaaggtaaccaccaggaaatcgacgcgctgaaatctttcgacaaattctctggttacttcatcggtctgcacgaaaaccgtaaaaacatgtactctgacggtgacgaaatcaccgcgatctctaaccgtatcgttaacgaaaacttcccgaaattcctggacaacctgcagaaataccaggaagcgcgtaaaaaatacccggaatggatcatcaaagcggaatctgcgctggttgcgcacaacatcaaaatggacgaagttttctctctggaatacttcaacaaagttctgaaccaggaaggtatccagcgttacaacctggcgctgggtggttacgttaccaaatctggtgaaaaaatgatgggtctgaacgacgcgctgaacctggcgcaccagtctgaaaaatcttctaaaggtcgtatccacatgaccccgctgttcaaacagatcctgtctgaaaaagaatctttctcttacatcccggacgttttcaccgaagactctcagctgctgccgtctatcggtggtttcttcgcgcagatcgaaaacgacaaagacggtaacatcttcgaccgtgcgctggaactgatctcttcttacgcggaatacgacaccgaacgtatctacatccgtcaggcggacatcaaccgtgtttctaacgttatcttcggtgaatggggtaccctgggtggtctgatgcgtgaatacaaagcggactctatcaacgacatcaacctggaacgtacctgcaaaaaagttgacaaatggctggactctaaagaattcgcgctgtctgacgttctggaagcgatcaaacgtaccggtaacaacgacgcgttcaacgaatacatctctaaaatgcgtaccgcgcgtgaaaaaatcgacgcggcgcgtaaagaaatgaaattcatctctgaaaaaatctctggtgacgaagaatctatccacatcatcaaaaccctgctggactctgttcagcagttcctgcacttcttcaacctgttcaaagcgcgtcaggacatcccgctggacggtgcgttctacgcggaattcgacgaagttcactctaaactgttcgcgatcgttccgctgtacaacaaagttcgtaactacctgaccaaaaacaacctgaacaccaaaaaaatcaaactgaacttcaaaaacccgaccctggcgaacggttgggaccagaacaaagtttacgactacgcgtctctgatcttcctgcgtgacggtaactactacctgggtatcatcaacccgaaacgtaaaaaaaacatcaaattcgaacagggttctggtaacggtccgttctaccgtaaaatggtttacaaacagatcccgggtccgaacaaaaacctgccgcgtgttttcctgacctctaccaaaggtaaaaaagaatacaaaccgtctaaagaaatcatcgaaggttacgaagcggacaaacacatccgtggtgacaaattcgacctggacttctgccacaaactgatcgacttcttcaaagaatctatcgaaaaacacaaagactggtctaaattcaacttctacttctctccgaccgaatcttacggtgacatctctgaattctacctggacgttgaaaaacagggttaccgtatgcacttcgaaaacatctctgcggaaaccatcgacgaatacgttgaaaaaggtgacctgttcctgttccagatctacaacaaagacttcgttaaagcggcgaccggtaaaaaagacatgcacaccatctactggaacgcggcgttctctccggaaaacctgcaggacgttgttgttaaactgaacggtgaagcggaactgttctaccgtgacaaatctgacatcaaagaaatcgttcaccgtgaaggtgaaatcctggttaaccgtacctacaacggtcgtaccccggttccggacaaaatccacaaaaaactgaccgactaccacaacggtcgtaccaaagacctgggtgaagcgaaagaatacctggacaaagttcgttacttcaaagcgcactacgacatcaccaaagaccgtcgttacctgaacgacaaaatctacttccacgttccgctgaccctgaacttcaaagcgaacggtaaaaaaaacctgaacaaaatggttatcgaaaaattcctgtctgacgaaaaagcgcacatcatcggtatcgaccgtggtgaacgtaacctgctgtactactctatcatcgaccgttctggtaaaatcatcgaccagcagtctctgaacgttatcgacggtttcgactaccgtgaaaaactgaaccagcgtgaaatcgaaatgaaagacgcgcgtcagtcttggaacgcgatcggtaaaatcaaagacctgaaagaaggttacctgtctaaagcggttcacgaaatcaccaaaatggcgatccagtacaacgcgatcgttgttatggaagaactgaactacggtttcaaacgtggtcgtttcaaagttgaaaaacagatctaccagaaattcgaaaacatgctgatcgacaaaatgaactacctggttttcaaagacgcgccggacgaatctccgggtggtgttctgaacgcgtaccagctgaccaacccgctggaatctttcgcgaaactgggtaaacagaccggtatcctgttctacgttccggcggcgtacacctctaaaatcgacccgaccaccggtttcgttaacctgttcaacacctcttctaaaaccaacgcgcaggaacgtaaagaattcctgcagaaattcgaatctatctcttactctgcgaaagacggtggtatcttcgcgttcgcgttcgactaccgtaaattcggtacctctaaaaccgaccacaaaaacgtttggaccgcgtacaccaacggtgaacgtatgcgttacatcaaagaaaaaaaacgtaacgaactgttcgacccgtctaaagaaatcaaagaagcgctgacctcttctggtatcaaatacgacggtggtcagaacatcctgccggacatcctgcgttctaacaacaacggtctgatctacaccatgtactcttctttcatcgcggcgatccagatgcgtgtttacgacggtaaagaagactacatcatctctccgatcaaaaactctaaaggtgaattcttccgtaccgacccgaaacgtcgtgaactgccgatcgacgcggacgcgaacggtgcgtacaacatcgcgctgcgtggtgaactgaccatgcgtgcgatcgcggaaaaattcgacccggactctgaaaaaatggcgaaactggaactgaaacacaaagactggttcgaattcatgcagacccgtggtgactaa

SEQ ID NO: 44 - DNA, 3897 bp, Artificial Sequence
  Description of Artificial Sequence: Synthetic polynucleotide
atgactaaaacatttgattcagagttttttaatttgtactcgctgcaaaaaacggtacgctttgagttaaaacccgtgggagaaaccgcgtcatttgtggaagactttaaaaacgagggcttgaaacgtgttgtgagcgaagatgaaaggcgagccgtcgattaccagaaagttaaggaaataattgacgattaccatcgggatttcattgaagaaagtttaaattattttccggaacaggtgagtaaagatgctcttgagcaggcgtttcatctttatcagaaactgaaggcagcaaaagttgaggaaagggaaaaagcgctgaaagaatgggaagcgctgcagaaaaagctacgtgaaaaagtggtgaaatgcttctcggactcgaataaagcccgcttctcaaggattgataaaaaggaactgattaaggaagacctgataaattggttggtcgcccagaatcgcgaggatgatatccctacggtcgaaacgtttaacaacttcaccacatattttaccggcttccatgagaatcgtaaaaatatttactccaaagatgatcacgccaccgctattagctttcgccttattcatgaaaatcttccaaagttttttgacaacgtgattagcttcaataagttgaaagagggtttccctgaattaaaatttgataaagtgaaagaggatttagaagtagattatgatctgaagcatgcgtttgaaatagaatatttcgttaacttcgtgacccaagcgggcatagatcagtataattatctgttaggagggaaaaccctggaggacgggacgaaaaaacaagggatgaatgagcaaattaatctgttcaaacaacagcaaacgcgagataaagcgcgtcagattcccaaactgatccccctgttcaaacagattcttagcgaaaggactgaaagccagtcctttattcctaaacaatttgaaagtgatcaggagttgttcgattcactgcagaagttacataataactgccaggataaattcaccgtgctgcaacaagccattctcggtctggcagaggcggatcttaagaaggtcttcatcaaaacctctgatttaaatgccttatctaacaccattttcgggaattacagcgtcttttccgatgcactgaacctgtataaagaaagcctgaaaacgaaaaaagcgcaggaggcttttgagaaactaccggcccattctattcacgacctcattcaatacttggaacagttcaattccagcctggacgcggaaaaacaacagagcaccgacaccgtcctgaactacttcatcaagaccgatgaattatattctcgcttcattaaatccactagcgaggctttcactcaggtgcagcctttgttcgaactggaagccctgtcatctaagcgccgcccaccggaatcggaagatgaaggggcaaaagggcaggaaggcttcgagcagatcaagcgtattaaagcttacctggatacgcttatggaagcggtacactttgcaaagccgttgtatcttgttaagggtcgtaaaatgatcgaagggctcgataaagaccagtccttttatgaagcgtttgaaatggcgtaccaagaacttgaatcgttaatcattcctatctataacaaagcgcggagctatctgtcgcggaaacctttcaaggccgataaattcaagattaattttgacaacaacacgctactgagcggatgggatgcgaacaaggaaactgctaacgcgtccattctgtttaagaaagacgggttatattaccttggaattatgccgaaaggtaagacctttctctttgactactttgtatcgagcgaggattcagagaaactgaaacagcgtcgccagaagaccgccgaagaagctctggcgcaggatggtgaaagttacttcgaaaaaattcgttataaactgttaccaggggcttcaaagatgttaccgaaagtcttttttagcaacaaaaatattggcttttacaacccgtcggatgacattttacgcattcgcaacacagcctctcacaccaaaaacgggacccctcagaaaggccactcaaaagttgagtttaacctgaatgattgtcataagatgattgatttcttcaaatcatcaattcagaaacacccggaatgggggtcttttggctttacgttttctgataccagtgattttgaagacatgagtgccttctaccgggaagtagaaaaccagggttacgtaattagctttgacaaaatcaaagagacctatatacagagccaggtggaacagggtaatctctacttattccagatttataacaaggatttctcgccctacagcaaaggcaaaccaaacctgcatactctgtactggaaagccctgtttgaagaagcgaacctgaataacgtagtggcgaagttgaacggtgaagcggaaatcttcttccgtcgtcactccattaaggcctctgataaagttgtccatccggcaaatcaggccattgataataagaatccacacacggaaaaaacgcagtcaacctttgaatatgacctcgttaaagacaaacgctacacgcaagataagttctttttccacgtcccaatcagcctcaactttaaagcacaaggggtttcaaagtttaatgataaagtcaatgggttcctcaagggcaacccggatgtcaacattataggtatagacaggggcgaacgccatctgctttactttaccgtagtgaatcagaaaggtgaaatactggttcaggaatcattaaataccttgatgtcggacaaagggcacgttaatgattaccagcagaaactggataaaaaagaacaggaacgtgatgctgcgcgtaaatcgtggaccacggttgagaacattaaagagctgaaagaggggtatctaagccatgtggtacacaaactggcgcacctcatcattaaatataacgcaatagtctgcctagaagacttgaattttggctttaaacgcggccgcttcaaagtggaaaaacaagtttatcaaaaatttgaaaaggcgcttatagataaactgaattatctggtttttaaagaaaaggaacttggtgaggtagggcactacttgacagcttatcaactgacggccccgttcgaatcattcaaaaaactgggcaaacagtctggcattctgttttacgtgccggcagattatacttcaaaaatcgatccaacaactggctttgtgaacttcctggacctgagatatcagtctgtagaaaaagctaaacaacttcttagcgattttaatgccattcgttttaacagcgttcagaattactttgaattcgaaattgactataaaaaacttactccgaaacgtaaagtcggaacccaaagtaaatgggtaatttgtacgtatggcgatgtcaggtatcagaaccgtcggaatcaaaaaggtcattgggagaccgaagaagtgaacgtgaccgaaaagctgaaggctctgttcgccagcgattcaaaaactacaactgtgatcgattacgcaaatgatgataacctgatagatgtgattttagagcaggataaagccagcttttttaaagaactgttgtggctcctgaaacttacgatgaccttacgacattccaagatcaaatcggaagatgattttattctgtcaccggtcaagaatgagcagggtgaattctatgatagtaggaaagccggcgaagtgtggccgaaagacgccgacgccaatggcgcctatcatatcgcgctcaaagggctttggaatttgcagcagattaaccagtgggaaaaaggtaaaaccctgaatctggctatcaaaaaccaggattggtttagctttatccaagagaaaccgtatcaggaatga

SEQ ID NO: 45 - DNA, 3708 bp, Artificial Sequence
  Description of Artificial Sequence: Synthetic polynucleotide
atgcatacaggcggtcttcttagtatggacgcgaaagagttcacaggtcagtatccgttgtcgaaaacattacgattcgaacttcggcccatcggccgcacgtgggataacctggaggcctcaggctacttagcggaagaccgccatcgtgccgaatgttatcctcgtgcgaaagagttattggatgacaaccatcgtgccttcctgaatcgtgtgttgccacaaatcgatatggattggcacccgattgcggaggccttttgtaaggtacataaaaaccctggtaataaagaacttgcccaggattacaaccttcagttgtcaaagcgccgtaaggagatcagcgcatatcttcaggatgcagatggctataaaggcctgttcgcgaagcccgccttagacgaagctatgaaaattgcgaaagaaaacgggaacgaaagtgatattgaggttctcgaagcgtttaacggttttagcgtatacttcaccggttatcatgagtcacgcgagaacatttatagcgatgaggatatggtgagcgtagcctaccgaattactgaggataatttcccgcgctttgtctcaaacgctttgatctttgataaattaaacgaaagccatccggatattatctctgaagtatcgggcaatcttggagttgatgacattggtaagtactttgacgtgtcgaactataacaattttctttcccaggccggtatagatgactacaatcacattattggcggccatacaaccgaagacggactgatacaagcgtttaatgtcgtattgaacttacgtcaccaaaaagaccctggctttgaaaaaattcagttcaaacagctctacaaacaaatcctgagcgtgcgtaccagcaaaagctacatcccgaaacagtttgacaactctaaggagatggttgactgcatttgcgattatgtcagcaaaatagagaaatccgaaacagtagaacgggccctgaaactagtccgtaatatcagttctttcgacttgcgcgggatctttgtcaataaaaagaacttgcgcatactgagcaacaaactgataggagattgggacgcgatcgaaaccgcattgatgcatagttcttcatcagaaaacgataagaaaagcgtatatgatagcgcggaggcttttacgttggatgacatcttttcaagcgtgaaaaaattttctgatgcctctgccgaagatattggcaacagggcggaagacatctgtagagtgataagtgagacggccccttttatcaacgatctgcgagcggtggacctggatagcctgaacgacgatggttatgaagcggccgtctcaaaaattcgggagtcgctggagccttatatggatcttttccatgaactggaaattttctcggttggcgatgagttcccaaaatgcgcagcattttacagcgaactggaggaagtcagcgaacagctgatcgaaattattccgttattcaacaaggcgcgttcgttctgcacccggaaacgctatagcaccgataagattaaagtgaacttaaaattcccgaccttggcggacgggtgggacctgaacaaagagagagacaacaaagccgcgattctgcggaaagacggtaagtattatctggcaattctggatatgaagaaagatctgtcaagcattaggaccagcgacgaagatgaatccagcttcgaaaagatggagtataaactgttaccgagtccagtaaaaatgctgccaaagatattcgtaaaatcgaaagccgctaaggaaaaatatggcctgacagatcgtatgcttgaatgctacgataaaggtatgcataagtcgggtagtgcgtttgatcttggcttttgccatgaactcattgattattacaagcgttgtatcgcggagtacccaggctgggatgtgttcgatttcaagtttcgcgaaacttccgattatgggtccatgaaagagttcaatgaagatgtggccggagccggttactatatgagtctgagaaaaattccgtgcagcgaagtgtaccgtctgttagacgagaaatcgatttatctatttcaaatttataacaaagattactctgaaaatgcacatggtaataagaacatgcataccatgtactgggagggtctcttttccccgcaaaacctggagtcgcccgttttcaagttgtcgggtggggcagaacttttctttcgaaaatcctcaatccctaacgatgccaaaacagtacacccgaaaggctcagtgctggttccacgtaatgatgttaacggtcggcgtattccagattcaatctaccgcgaactgacacgctattttaaccgtggcgattgccgaatcagtgacgaagccaaaagttatcttgacaaggttaagactaaaaaagcggaccatgacattgtgaaagatcgccgctttaccgtggataaaatgatgttccacgtcccgattgcgatgaactttaaggcgatcagtaaaccgaacttaaacaaaaaagtcattgatggcatcattgatgatcaggatctgaaaatcattggtattgatcgtggcgagcggaacttaatttacgtcacgatggttgacagaaaagggaatatcttatatcaggattctcttaacatcctcaatggctacgactatcgtaaagctctggatgtgcgcgaatatgacaacaaggaagcgcgtcgtaactggactaaagtggagggcattcgcaaaatgaaggaaggctatctgtcattagcggtctcgaaattagcggatatgattatcgaaaataacgccatcatcgttatggaggacctgaaccacggattcaaagcgggccgctcaaagattgaaaaacaagtttatcagaaatttgagagtatgctgattaacaaactgggctatatggtgttaaaagacaagtcaattgaccaatcaggtggcgcgctgcatggataccagctggcgaaccatgttaccaccttagcatcagttggaaagcagtgtggggttatcttttatataccggcagcgttcactagtaaaatagatccgaccactggtttcgccgatctctttgccctgagtaacgttaaaaacgtagcgagcatgcgtgaattcttttccaaaatgaaatctgtcatttatgataaagctgaaggcaaattcgcattcacctttgattacttggattacaacgtgaagagcgaatgtggtcgtacgctgtggaccgtttacaccgttggtgagcgcttcacctattcccgtgtgaaccgcgaatatgtacgtaaagtccccaccgatattatctatgatgccctccagaaagcaggcattagcgtcgaaggagacttaagggacagaattgccgaaagcgatggcgatacgctgaagtctattttttacgcattcaaatacgcgctagatatgcgcgttgagaatcgcgaggaagactacattcaatcacctgtgaaaaatgcctctggggaatttttttgttcaaaaaatgctggtaaaagcctcccacaagatagcgatgcaaacggtgcatataacattgccctgaaaggtattcttcaattacgcatgctgtctgagcagtacgaccccaacgcggaatctattagacttccgctgataaccaataaagcctggctgacattcatgcagtctggcatgaagacctggaaaaattag

SEQ ID NO: 46 - DNA, 3783 bp, Artificial Sequence
  Description of Artificial Sequence: Synthetic polynucleotide
atggatagtttaaaagattttacgaatctatatcccgtaagcaaaactcttcgttttgaactgaaacctgttggaaaaacgttggagaatatcgagaaagcgggcatcctgaaagaagacgagcaccgtgccgaaagctacaggcgtgtcaaaaagattatcgatacttatcacaaagtgttcattgatagcagtctggagaacatggcaaaaatgggcatagaaaatgaaatcaaagcaatgctgcagagcttttgcgagctctacaagaaagatcaccgaacggaaggtgaagataaagcactggacaaaattcgcgccgttcttcgcggtctgattgttggcgcgttcaccggcgtgtgcggccgccgtgaaaacaccgtgcagaacgaaaagtacgagtcgctgttcaaagaaaaactgataaaagaaattttgcctgactttgtgctttcgaccgaagcggaatccctgccattttctgtcgaagaagcgacccgcagcctgaaagaatttgactcattcacaagttactttgcaggcttctacgaaaaccgtaaaaacatctacagcacgaagccacagagcacggctattgcttatcgcctgattcatgagaacctgccgaagttcatcgataacatccttgtttttcaaaaaattaaagagccgattgcgaaagagttagaacatattcgagctgacttttctgcgggtgggtacattaaaaaagatgagcggctggaagacatcttcagtctaaactattatatccacgttctgtcgcaggcaggcattgagaaatataatgcgctgattggtaagattgtcacagaaggcgatggtgagatgaaaggtcttaatgaacatatcaatctgtataaccagcagcgtggtcgcgaagaccgtcttccactgttccgcccactgtataaacagatcctgtctgaccgggaacagctgtcctacctgccggaaagctttgaaaaggatgaagagctacttcgcgcattaaaggagttttacgaccatattgcggaagacattttgggtagaacgcagcaactgatgacgtcaatttctgaatacgatctgagtagaatctacgttaggaatgatagccagctgaccgatattagcaaaaaaatgctgggcgactggaacgctatctatatggcacgtgaacgtgcatatgatcatgaacaagcaccgaaacgtataaccgcgaaatatgagcgtgatcgcattaaggcgctaaagggagaagaaagcatctcactcgcaaacctgaactcctgtatcgctttcttagataacgtgcgcgattgtcgcgtcgacacgtatctgtcaacccttgggcagaaagagggtccacatggtctgtctaacctggtggaaaatgtctttgcgagttaccatgaagcggaacaactgctgtcttttccataccccgaagaaaacaatctaatacaggataaagataacgtggtgttaatcaaaaacctgctggacaacatcagcgatctgcaacgtttcctgaaacctttgtggggtatgggtgacgagccagacaaagacgaacgtttttatggtgagtataattatatacgtggcgcccttgaccaagttattccgctgtataacaaagtacggaactatctgacccgtaagccatattctacccgtaaagtgaaactgaactttggcaactcgcaactgctgtcgggttgggatcgtaacaaagaaaaagataatagttgtgttatcctgcgtaagggacaaaatttttacctcgcgattatgaacaacagacacaagcgttcatttgaaaataaggttctgccggagtataaagagggcgaaccgtacttcgagaaaatggattataagttcttaccagaccctaataagatgttaccgaaagtctttctttcgaaaaaaggcatagaaatctataagccgtccccgaaattactcgaacagtatgggcacgggacccacaagaaaggggatacttttagcatggacgatctgcacgaactgatcgatttttttaaacactccatcgaagcccatgaagactggaaacagtttgggttcaagttctctgatacagccacatacgagaatgtgtctagtttttatcgggaagtggaggatcagggctacaaacttagttttcgtaaagtttcagagagttatgtttatagtttaattgatcagggaaaactttacctgttccagatctacaacaaagatttctcgccatgtagtaagggtaccccgaatctgcatacactctattggagaatgttattcgatgagcgtaacttagcggatgtcatttataaattggacgggaaagcagagatcttttttcgtgaaaaatcactgaagaatgaccacccgactcatccggccgggaaaccgatcaaaaaaaaatcccgccagaaaaaaggagaagagtctctgtttgaatatgatctggtgaaagaccgtcattacactatggataaatttcaatttcatgttccaattacaatgaacttcaaatgttcggcgggttccaaagtaaatgatatggtaaacgcccatattcgcgaagcgaaagatatgcatgttattggcatcgatagaggcgaaagaaacctgctttatatttgcgtaattgacagccgtggtaccattctggaccagatctctttaaacaccatcaatgacatcgattatcacgacctgttggagtctcgggacaaggaccgccagcaggagcgccgtaattggcagacaattgaaggcataaaagaattaaaacagggttacctttcccaggccgtacaccgcatagcggaactgatggtggcctacaaagccgtagttgccctggaagacttgaatatggggtttaaacgtggccgtcaaaaagtcgagagcagcgtgtatcagcaatttgaaaaacagttgattgacaagttgaattatttggttgataaaaagaaacgtccagaagatattggtggcttactgcgtgcataccagtttacggcaccttttaagtccttcaaagaaatgggtaaacagaacgggtttctgttttacatcccggcctggaatacatccaacatcgatcctaccaccgggtttgtcaacctgtttcatgcacaatatgaaaacgtggataaagcgaagagttttttccaaaaattcgatagtatttcgtataacccaaaaaaagattggtttgagtttgcgttcgattataaaaattttactaaaaaggctgagggatcccgcagtatgtggatcctctgcacccatggcagtcgtattaaaaattttcgtaattcgcaaaagaatggccagtgggactcggaagagtttgccctgaccgaagcgttcaaatcgctgtttgtacgctacgaaattgactacacagcagatctgaaaacagccatcgtcgatgaaaaacagaaagatttttttgtagatctcctaaaactgttcaaactgactgttcagatgcgcaattcctggaaagagaaagacctggattatctgattagcccggtagccggtgctgatggacgatttttcgatactcgtgaaggtaacaaaagtctcccgaaagatgctgatgccaatggtgcatacaatattgcattaaaggggctatgggccttgcgacagatccgccagaccagcgaaggcggcaagctgaaattggccatatcgaataaggaatggttacaatttgttcaggaacgtagctatgaaaaagattga

SEQ ID NO: 47 - DNA, 3792 bp, Artificial Sequence
  Description of Artificial Sequence: Synthetic polynucleotide
atgaacaacggcacaaataattttcagaacttcatcgggatctcaagtttgcagaaaacgctgcgcaatgctctgatccccacggaaaccacgcaacagttcatcgtcaagaacggaataattaaagaagatgagttacgtggcgagaaccgccagattctgaaagatatcatggatgactactaccgcggattcatctctgagactctgagttctattgatgacatagattggactagcctgttcgaaaaaatggaaattcagctgaaaaatggtgataataaagataccttaattaaggaacagacagagtatcggaaagcaatccataaaaaatttgcgaacgacgatcggtttaagaacatgtttagcgccaaactgattagtgacatattacctgaatttgtcatccacaacaataattattcggcatcagagaaagaggaaaaaacccaggtgataaaattgttttcgcgctttgcgactagctttaaagattacttcaagaaccgtgcaaattgcttttcagcggacgatatttcatcaagcagctgccatcgcatcgtcaacgacaatgcagagatattcttttcaaatgcgctggtctaccgccggatcgtaaaatcgctgagcaatgacgatatcaacaaaatttcgggcgatatgaaagattcattaaaagaaatgagtctggaagaaatatattcttacgagaagtatggggaatttattacccaggaaggcattagcttctataatgatatctgtgggaaagtgaattcttttatgaacctgtattgtcagaaaaataaagaaaacaaaaatttatacaaacttcagaaacttcacaaacagattctatgcattgcggacactagctatgaggtcccgtataaatttgaaagtgacgaggaagtgtaccaatcagttaacggcttccttgataacattagcagcaaacatatagtcgaaagattacgcaaaatcggcgataactataacggctacaacctggataaaatttatatcgtgtccaaattttacgagagcgttagccaaaaaacctaccgcgactgggaaacaattaataccgccctcgaaattcattacaataatatcttgccgggtaacggtaaaagtaaagccgacaaagtaaaaaaagcggttaagaatgatttacagaaatccatcaccgaaataaatgaactagtgtcaaactataagctgtgcagtgacgacaacatcaaagcggagacttatatacatgagattagccatatcttgaataactttgaagcacaggaattgaaatacaatccggaaattcacctagttgaatccgagctcaaagcgagtgagcttaaaaacgtgctggacgtgatcatgaatgcgtttcattggtgttcggtttttatgactgaggaacttgttgataaagacaacaatttttatgcggaactggaggagatttacgatgaaatttatccagtaattagtctgtacaacctggttcgtaactacgttacccagaaaccgtacagcacgaaaaagattaaattgaactttggaataccgacgttagcagacggttggtcaaagtccaaagagtattctaataacgctatcatactgatgcgcgacaatctgtattatctgggcatctttaatgcgaagaataaaccggacaagaagattatcgagggtaatacgtcagaaaataagggtgactacaaaaagatgatttataatttgctcccgggtcccaacaaaatgatcccgaaagttttcttgagcagcaagacgggggtggaaacgtataaaccgagcgcctatatcctagaggggtataaacagaataaacatatcaagtcttcaaaagactttgatatcactttctgtcatgatctgatcgactacttcaaaaactgtattgcaattcatcccgagtggaaaaacttcggttttgattttagcgacaccagtacttatgaagacatttccgggttttatcgtgaggtagagttacaaggttacaagattgattggacatacattagcgaaaaagacattgatctgctgcaggaaaaaggtcaactgtatctgttccagatatataacaaagatttttcgaaaaaatcaaccgggaatgacaaccttcacaccatgtacctgaaaaatcttttctcagaagaaaatcttaaggatatcgtcctgaaacttaacggcgaagcggaaatcttcttcaggaagagcagcataaagaacccaatcattcataaaaaaggctcgattttagtcaaccgtacctacgaagcagaagaaaaagaccagtttggcaacattcaaattgtgcgtaaaaatattccggaaaacatttatcaggagctgtacaaatacttcaacgataaaagcgacaaagagctgtctgatgaagcagccaaactgaagaatgtagtgggacaccacgaggcagcgacgaatatagtcaaggactatcgctacacgtatgataaatacttccttcatatgcctattacgatcaatttcaaagccaataaaacgggttttattaatgataggatcttacagtatatcgctaaagaaaaagacttacatgtgatcggcattgatcggggcgagcgtaacctgatctacgtgtccgtgattgatacttgtggtaatatagttgaacagaaaagctttaacattgtaaacggctacgactatcagataaaactgaaacaacaggagggcgctagacagattgcgcggaaagaatggaaagaaattggtaaaattaaagagatcaaagagggctacctgagcttagtaatccacgagatctctaaaatggtaatcaaatacaatgcaattatagcgatggaggatttgtcttatggttttaaaaaagggcgctttaaggtcgaacggcaagtttaccagaaatttgaaaccatgctcatcaataaactcaactatctggtatttaaagatatttcgattaccgagaatggcggtctcctgaaaggttatcagctgacatacattcctgataaacttaaaaacgtgggtcatcagtgcggctgcattttttatgtgcctgctgcatacacgagcaaaattgatccgaccaccggctttgtgaatatctttaaatttaaagacctgacagtggacgcaaaacgtgaattcattaaaaaatttgactcaattcgttatgacagtgaaaaaaatctgttctgctttacatttgactacaataactttattacgcaaaacacggtcatgagcaaatcatcgtggagtgtgtatacatacggcgtgcgcatcaaacgtcgctttgtgaacggccgcttctcaaacgaaagtgataccattgacataaccaaagatatggagaaaacgttggaaatgacggacattaactggcgcgatggccacgatcttcgtcaagacattatagattatgaaattgttcagcacatattcgaaattttccgtttaacagtgcaaatgcgtaactccttgtctgaactggaggaccgtgattacgatcgtctcatttcacctgtactgaacgaaaataacattttttatgacagcgcgaaagcgggggatgcacttcctaaggatgccgatgcaaatggtgcgtattgtattgcattaaaagggttatatgaaattaaacaaattaccgaaaattggaaagaagatggtaaattttcgcgcgataaactcaaaatcagcaataaagattggttcgactttatccagaataagcgctatctctaa

SEQ ID NO: 48 - DNA, 3957 bp, Artificial Sequence
  Description of Artificial Sequence: Synthetic polynucleotide
atgaccaataaattcactaaccagtattctctctctaagaccctgcgctttgaactgattccgcaggggaaaaccttggagttcattcaagaaaaaggcctcttgtctcaggataaacagagggctgaatcttaccaagaaatgaagaaaactattgataagtttcataaatatttcattgatttagccttgtctaacgccaaattaactcacttggaaacgtatctggagttatacaacaaatctgccgaaactaagaaagaacagaaatttaaagacgatttgaaaaaagtacaggacaatctgcgtaaagaaattgtcaaatccttcagtgacggcgatgctaaaagcatttttgccattctggacaaaaaagagttgattactgtggaattagaaaagtggtttgaaaacaatgagcagaaagacatctacttcgatgagaaattcaaaactttcaccacctattttacaggatttcatcaaaaccggaagaacatgtactcagtagaaccgaactccacggccattgcgtatcgtttgatccatgagaatctgcctaaatttctggagaatgcgaaagcctttgaaaagattaagcaggtcgaatcgctgcaagtgaattttcgtgaactcatgggcgaatttggtgacgaaggtctaatcttcgttaacgaactggaagaaatgtttcagattaattactacaatgacgtgctatcgcagaacggtatcacaatctacaatagtattatctcagggttcacaaaaaacgatataaaatacaaaggcctgaacgagtatatcaataactacaaccaaacaaaggacaaaaaggataggcttccgaaactgaagcagttatacaaacagattttatctgacagaatctccctgagctttctgccggatgctttcactgatgggaagcaggttctgaaagcgattttcgatttttataagattaacttactgagctacacgattgaaggtcaagaagaatctcaaaacttactgctcttgatccgtcaaaccattgaaaatctatcatcgttcgatacgcagaaaatctacctcaaaaacgatactcacctgactacgatctctcagcaggttttcggggattttagtgtattttcaacagctctgaactactggtatgaaaccaaagtcaatccgaaattcgagacggaatattctaaggccaacgaaaaaaaacgtgagattcttgataaagctaaagccgtatttactaaacaggattacttttctattgctttcctgcaggaagttttatcggagtatatcctgaccctggatcatacatctgatatcgttaaaaaacacagcagcaattgcatcgctgactatttcaaaaaccactttgtcgccaaaaaagaaaacgaaacagacaagactttcgatttcattgctaacatcaccgcaaaataccagtgtattcagggtatcttggaaaacgccgaccaatacgaagacgaactgaaacaagatcagaagctgatcgataatttaaaattcttcttagatgcaatcctggagctgctgcacttcatcaaaccgcttcatttaaagagcgagtccattaccgaaaaggacaccgccttctatgacgtttttgaaaattattatgaagccctctccttgctgactccgctgtataatatggtacgcaattacgtaacccagaaaccatattctaccgaaaaaattaaactgaactttgaaaacgcacagctgctcaacggttgggacgcgaataaagaaggtgactacctcaccaccatcctgaaaaaagatggtaactattttctggcaattatggataagaaacataataaagcattccagaaatttcctgaagggaaagaaaattacgaaaagatggtgtacaaactcttacctggagttaacaaaatgttgccgaaagtattttttagtaataagaacatcgcgtactttaacccgtccaaagaactgctggaaaattataaaaaggagacgcataagaaaggggatacctttaacctggaacattgccataccttaatagacttcttcaaggattccctgaataaacacgaggattggaaatatttcgattttcagtttagtgagaccaagtcataccaggatcttagcggcttttatcgcgaagtagaacaccaaggctataaaattaacttcaaaaacatcgacagcgaatacatcgacggtttagttaacgagggcaaactgtttctgttccagatctattcaaaggattttagcccgttctctaaaggcaaaccaaatatgcatacgttgtactggaaagcactgtttgaagagcaaaacctgcagaatgtgatttataaactgaacggccaagctgagatttttttccgtaaagcctcgattaaaccgaaaaatatcatccttcataagaagaaaataaagatcgctaaaaaacacttcatagataaaaaaaccaaaacctccgaaatagtgcctgttcaaacaattaagaacttgaatatgtactaccagggcaagatatcggaaaaggagttgactcaagacgatcttcgctatatcgataacttttcgatttttaacgaaaaaaacaagacgatcgacatcatcaaagataaacgcttcactgtagataagttccagtttcatgtgccgattactatgaacttcaaagctaccgggggtagctatatcaaccaaacggtgttggaatacctgcagaataacccggaagtcaaaatcattgggctggaccgcggagaacgtcaccttgtgtacttgaccttaatcgatcagcaaggcaacatcttaaaacaagaatcgctgaataccattacggattcaaagattagcaccccgtatcataagctgctcgataacaaggagaatgagcgcgacctggcccgtaaaaactggggcacggtggaaaacattaaggagttaaaggagggttatatttcccaggtagtgcataagatcgccactctcatgctcgaggaaaatgcgatcgttgtcatggaagacttaaacttcggatttaaacgtgggcgatttaaagtagagaaacaaatctaccagaagttagaaaaaatgctgattgacaaattaaattacttggtcctaaaagacaaacagccgcaagaattgggtggattatacaacgccctccaacttaccaataaattcgaaagttttcagaaaatgggtaaacagtcaggctttcttttttatgttcctgcgtggaacacatccaaaatcgaccctacaaccggcttcgtcaattacttctatactaaatatgaaaacgtcgacaaagcaaaagcattctttgaaaagttcgaagcaatacgttttaacgctgagaaaaaatatttcgagttcgaagtcaagaaatactcagactttaaccccaaagctgagggcacacagcaagcgtggacaatctgcacctacggcgagcgcatcgaaacgaagcgtcaaaaagatcagaataacaaatttgtttcaacacctatcaacctgaccgagaagattgaagacttcttaggtaaaaatcagattgtttatggcgacggtaactgtataaaatctcaaatagcctcaaaggatgataaagcatttttcgaaacattattatattggttcaaaatgacactgcagatgcgcaatagtgagacgcgtacagatattgattatcttatcagcccggtcatgaacgacaacggtactttttacaactccagagactatgaaaaacttgagaatccaactctccccaaagatgctgatgcgaacggtgcttatcacatcgcgaaaaaaggtctgatgctgctgaacaaaatcgaccaagccgatctgactaagaaagttgacctaagcatttcaaatcgggactggttacagtttgttcaaaagaacaaatga

SEQ ID NO: 49 - DNA, 4023 bp, Artificial Sequence
  Description of Artificial Sequence: Synthetic polynucleotide
atggaacaggaatattatctgggcttggacatgggcaccggttccgtcggctgggctgttactgacagtgaatatcacgttctaagaaagcatggtaaggcattgtggggtgtaagacttttcgaatctgcttccactgctgaagagcgtagaatgtttagaacgagtcgacgtaggctagacaggcgcaattggagaatcgaaattttacaagaaatttttgcggaagagatatctaagaaagacccaggctttttcctgagaatgaaggaatctaagtattaccctgaggataaaagagatataaatggtaactgtcccgaattgccttacgcattatttgtggacgatgattttaccgataaggattaccataaaaagttcccaactatctaccatttacgcaaaatgttaatgaatacagaggaaaccccagacataagactagtttatctggcaatacaccatatgatgaaacatagaggccatttcttactttccggggatatcaacgaaatcaaagagtttggtaccacatttagtaagttactggaaaacataaagaatgaagaattggattggaacttagaactcggaaaagaagaatacgcggttgtcgaatctatcctgaaggataatatgctgaataggtcgaccaaaaaaactaggctgatcaaagcactgaaagccaaatctatctgcgaaaaagctgttttaaatttacttgctggtggcactgttaagttatcagacatttttggtttggaagaattgaacgaaaccgagcgtccaaaaattagtttcgctgataatggctacgatgattacattggtgaggtggaaaacgagttgggcgaacaattttatattatagagacagctaaggcagtctatgactgggctgttttagtagaaatccttggtaaatacacatctatctccgaagcgaaagttgctacttacgaaaagcacaagtccgatctccagtttttgaagaaaattgtcaggaaatatctgactaaggaagaatataaagatattttcgttagtacctctgacaaactgaaaaattactccgcttacatcgggatgaccaagattaatggcaaaaaagttgatctgcaaagcaaaaggtgttcgaaggaagaattttatgatttcattaaaaagaatgtcttaaaaaaattagaaggtcagccagaatacgaatatttgaaagaagaactggaaagagagacattcttaccaaaacaagtcaacagagataatggggtaattccatatcaaattcacctctacgaattaaaaaaaattttaggcaatttacgcgataaaattgaccttatcaaagaaaatgaggataagctggttcaactctttgaattcagaataccctattatgtgggcccactgaacaagattgatgacggcaaagaaggtaaattcacatgggccgtccgcaaatccaatgaaaaaatttacccatggaactttgaaaatgtagtagatattgaagcgtctgcggagaaatttattcgaagaatgactaataaatgcacttacttgatgggagaggatgttctgcctaaagacagcttattatacagcaagtacatggttctaaacgaacttaacaacgttaagttggacggtgagaaattaagtgtagaattgaaacaaagattgtatactgacgtcttctgcaagtacagaaaagtgacagttaaaaaaattaagaattacttgaagtgcgaaggtataatttctggaaacgtagagattactggtattgatggtgatttcaaagcatccctaacagcttaccacgatttcaaggaaatcctgacaggaactgaactcgcaaaaaaagataaagaaaacattattactaatattgttcttttcggtgatgacaagaaattgttgaagaaaagactgaatagactttacccccagattactcccaatcaacttaagaaaatttgtgctttgtcttacacaggatggggtcgtttttcaaaaaagttcttagaagagattaccgcacctgatccagaaacaggcgaagtatggaatataattaccgccttatgggaatcgaacaataatcttatgcaacttctgagcaatgaatatcgtttcatggaagaagttgagacttacaacatgggcaaacagacgaagactttatcctatgaaactgtggaaaatatgtatgtatcaccttctgtcaagagacaaatttggcaaaccttaaaaattgtcaaagaattagaaaaggtaatgaaggagtctcctaaacgtgtgtttattgaaatggctagagaaaaacaagagtcaaaaagaaccgagtcaagaaagaagcagttaatcgatttatataaggcttgtaaaaacgaagagaaagattgggttaaagaattgggggaccaagaggaacaaaaactacggtcggataagttgtatttatactatacgcaaaagggacgatgtatgtattccggcgaggtaatagaattgaaggatttatgggacaatacaaaatatgacatagaccatatatatccccaatcaaaaacgatggacgatagcttgaacaatagagtactcgtgaaaaaaaaatataatgcgaccaaatctgataagtatcctctgaatgaaaatatcagacatgaaagaaaggggttctggaagtccttgttagatggtgggtttataagcaaagaaaagtacgagcgtctaataagaaacacggagttatcgccagaagaactcgctggttttattgagaggcaaatcgtggaaacgagacaatctaccaaagccgttgctgagatcctaaagcaagttttcccagagtcggagattgtctatgtcaaagctggcacagtgagcaggtttaggaaagacttcgaactattaaaggtaagagaagtgaacgatttacatcacgcaaaggacgcttacctaaatatcgttgtaggtaactcatattatgttaaatttaccaagaacgcctcttggtttataaaggagaacccaggtagaacatataacctgaaaaagatgttcacctctggttggaatattgagagaaacggagaagtcgcatgggaagttggtaagaaagggactatagtgacagtaaagcaaattatgaacaaaaataatatcctcgttacaaggcaggttcatgaagcaaagggcggcctttttgaccaacaaattatgaagaaagggaaaggtcaaattgcaataaaagaaaccgatgagagactagcgtcaatagaaaagtatggtggctataataaagctgcgggtgcatactttatgcttgttgaatcaaaagacaagaaaggtaagactattagaactatagaatttatacccctgtaccttaaaaacaaaattgaatcggatgagtcaatcgcgttaaattttctagagaaaggaaggggtttaaaagaaccaaagatcctgttaaaaaagattaagattgacaccttgttcgatgtagatggatttaaaatgtggttatctggcagaacaggcgatagacttttgtttaagtgcgctaatcaattaattttggatgagaaaatcattgtcacaatgaaaaaaatagttaagtttattcagagaagacaagaaaacagggagttgaaattatctgataaagatggtatcgacaatgaagttttaatggaaatctacaatacattcgttgataaacttgaaaataccgtatatcgaatcaggttaagtgaacaagccaaaacattaattgataaacaaaaagaatttgaaaggctatcactggaagacaaatcctccaccctatttgaaattttgcatatattccagtgccaatcttcagcagctaatttaaaaatgattggcggacctgggaaagccggcatcctagtgatgaacaataatatctccaagtgtaacaaaatatcaattattaaccaatctccgacaggtatttttgaaaatgaaatagacttgcttaagatataa

SEQ ID NO: 50 - DNA, 3831 bp, Artificial Sequence
  Description of Artificial Sequence: Synthetic polynucleotide
atgtctttcgactctttcaccaacctgtactctctgtctaaaaccctgaaattcgaaatgcgtccggttggtaacacccagaaaatgctggacaacgcgggtgttttcgaaaaagacaaactgatccagaaaaaatacggtaaaaccaaaccgtacttcgaccgtctgcaccgtgaattcatcgaagaagcgctgaccggtgttgaactgatcggtctggacgaaaacttccgtaccctggttgactggcagaaagacaaaaaaaacaacgttgcgatgaaagcgtacgaaaactctctgcagcgtctgcgtaccgaaatcggtaaaatcttcaacctgaaagcggaagactgggttaaaaacaaatacccgatcctgggtctgaaaaacaaaaacaccgacatcctgttcgaagaagcggttttcggtatcctgaaagcgcgttacggtgaagaaaaagacaccttcatcgaagttgaagaaatcgacaaaaccggtaaatctaaaatcaaccagatctctatcttcgactcttggaaaggtttcaccggttacttcaaaaaattcttcgaaacccgtaaaaacttctacaaaaacgacggtacctctaccgcgatcgcgacccgtatcatcgaccagaacctgaaacgtttcatcgacaacctgtctatcgttgaatctgttcgtcagaaagttgacctggcggaaaccgaaaaatctttctctatctctctgtctcagttcttctctatcgacttctacaacaaatgcctgctgcaggacggtatcgactactacaacaaaatcatcggtggtgaaaccctgaaaaacggtgaaaaactgatcggtctgaacgaactgatcaaccagtaccgtcagaacaacaaagaccagaaaatcccgttcttcaaactgctggacaaacagatcctgtctgaaaaaatcctgttcctggacgaaatcaaaaacgacaccgaactgatcgaagcgctgtctcagttcgcgaaaaccgcggaagaaaaaaccaaaatcgttaaaaaactgttcgcggacttcgttgaaaacaactctaaatacgacctggcgcagatctacatctctcaggaagcgttcaacaccatctctaacaaatggacctctgaaaccgaaaccttcgcgaaatacctgttcgaagcgatgaaatctggtaaactggcgaaatacgaaaaaaaagacaactcttacaaattcccggacttcatcgcgctgtctcagatgaaatctgcgctgctgtctatctctctggaaggtcacttctggaaagaaaaatactacaaaatctctaaattccaggaaaaaaccaactgggaacagttcctggcgatcttcctgtacgaattcaactctctgttctctgacaaaatcaacaccaaagacggtgaaaccaaacaggttggttactacctgttcgcgaaagacctgcacaacctgatcctgtctgaacagatcgacatcccgaaagactctaaagttaccatcaaagacttcgcggactctgttctgaccatctaccagatggcgaaatacttcgcggttgaaaaaaaacgtgcgtggctggcggaatacgaactggactctttctacacccagccggacaccggttacctgcagttctacgacaacgcgtacgaagacatcgttcaggtttacaacaaactgcgtaactacctgaccaaaaaaccgtactctgaagaaaaatggaaactgaacttcgaaaactctaccctggcgaacggttgggacaaaaacaaagaatctgacaactctgcggttatcctgcagaaaggtggtaaatactacctgggtctgatcaccaaaggtcacaacaaaatcttcgacgaccgtttccaggaaaaattcatcgttggtatcgaaggtggtaaatacgaaaaaatcgtttacaaattcttcccggaccaggcgaaaatgttcccgaaagtttgcttctctgcgaaaggtctggaattcttccgtccgtctgaagaaatcctgcgtatctacaacaacgcggaattcaaaaaaggtgaaacctactctatcgactctatgcagaaactgatcgacttctacaaagactgcctgaccaaatacgaaggttgggcgtgctacaccttccgtcacctgaaaccgaccgaagaataccagaacaacatcggtgaattcttccgtgacgttgcggaagacggttaccgtatcgacttccagggtatctctgaccagtacatccacgaaaaaaacgaaaaaggtgaactgcacctgttcgaaatccacaacaaagactggaacctggacaaagcgcgtgacggtaaatctaaaaccacccagaaaaacctgcacaccctgtacttcgaatctctgttctctaacgacaacgttgttcagaacttcccgatcaaactgaacggtcaggcggaaatcttctaccgtccgaaaaccgaaaaagacaaactggaatctaaaaaagacaaaaaaggtaacaaagttatcgaccacaaacgttactctgaaaacaaaatcttcttccacgttccgctgaccctgaaccgtaccaaaaacgactcttaccgtttcaacgcgcagatcaacaacttcctggcgaacaacaaagacatcaacatcatcggtgttgaccgtggtgaaaaacacctggtttactactctgttatcacccaggcgtctgacatcctggaatctggttctctgaacgaactgaacggtgttaactacgcggaaaaactgggtaaaaaagcggaaaaccgtgaacaggcgcgtcgtgactggcaggacgttcagggtatcaaagacctgaaaaaaggttacatctctcaggttgttcgtaaactggcggacctggcgatcaaacacaacgcgatcatcatcctggaagacctgaacatgcgtttcaaacaggttcgtggtggtatcgaaaaatctatctaccagcagctggaaaaagcgctgatcgacaaactgtctttcctggttgacaaaggtgaaaaaaacccggaacaggcgggtcacctgctgaaagcgtaccagctgtctgcgccgttcgaaaccttccagaaaatgggtaaacagaccggtatcatcttctacacccaggcgtcttacacctctaaatctgacccggttaccggttggcgtccgcacctgtacctgaaatacttctctgcgaaaaaagcgaaagacgacatcgcgaaattcaccaaaatcgaattcgttaacgaccgtttcgaactgacctacgacatcaaagacttccagcaggcgaaagaatacccgaacaaaaccgtttggaaagtttgctctaacgttgaacgtttccgttgggacaaaaacctgaaccagaacaaaggtggttacacccactacaccaacatcaccgaaaacatccaggaactgttcaccaaatacggtatcgacatcaccaaagacctgctgacccagatctctaccatcgacgaaaaacagaacacctctttcttccgtgacttcatcttctacttcaacctgatctgccagatccgtaacaccgacgactctgaaatcgcgaaaaaaaacggtaaagacgacttcatcctgtctccggttgaaccgttcttcgactctcgtaaagacaacggtaacaaactgccggaaaacggtgacgacaacggtgcgtacaacatcgcgcgtaaaggtatcgttatcctgaacaaaatctctcagtactctgaaaaaaacgaaaactgcgaaaaaatgaaatggggtgacctgtacgtttctaacatcgactgggacaacttcgtt

SEQ ID NO: 51 - DNA, 3465 bp, Artificial Sequence
  Description of Artificial Sequence: Synthetic polynucleotide
atggaaaactttaaaaacttatacccaataaacaaaacgttacgttttgaactgcgtccatatggtaaaacactggaaaactttaaaaaaagcggtttgttggagaaggatgcatttaaagcgaactctcgcagatccatgcaggccatcattgatgaaaaatttaaagagacgatcgaagaacgtctgaaatacacggaatttagtgagtgtgacttaggtaatatgacttctaaagataagaaaatcaccgataaggcggcgaccaacctgaagaagcaagtcattttatcttttgatgatgaaatctttaacaactatttgaaaccggacaaaaacatcgatgccttatttaaaaatgacccttcgaacccggtgattagcacatttaagggcttcacaacgtattttgtcaatttttttgaaattcgtaaacatatcttcaaaggagaatcaagcggctctatggcttatcgcattattgatgaaaacctgacgacctatttgaataacattgaaaaaatcaaaaaactgccagaggaattaaagtctcagttagaaggcatcgaccagatcgacaaactcaacaactataacgaatttattacgcagtctggtatcacccactataatgaaattattggaggtatcagtaaatcagaaaatgtgaaaatccaagggattaatgaaggcattaacctctattgccagaaaaataaagtgaaactgccgaggctgactccactctacaaaatgatcctgtctgaccgcgtctcgaatagctttgtcctggacacaattgaaaacgatacggaattgattgagatgataagcgatctgattaacaaaaccgaaatttcacaggatgtaatcatgagtgatatacaaaacatctttattaaatataaacagcttggtaatctgcctggaattagctattcgtcaatagtgaacgcaatctgttctgattatgataacaattttggcgacggtaagcgtaaaaagagttatgaaaacgataggaaaaaacacctggaaactaacgtgtattctatcaactatatcagcgaactgcttacggacaccgatgtgagttcaaacattaagatgcggtataaggagcttgaacagaactaccaggtctgtaaggaaaacttcaacgcaaccaactggatgaacattaaaaatatcaaacaatccgagaagaccaacttaatcaaagatctgctggatattttgaagagcattcaacgtttttatgatctgttcgatatcgttgatgaagacaagaatcctagtgcggaattttatacatggctgtctaaaaatgcggagaaattggatttcgaattcaattctgtttataataaatcacgcaactatttgacccgcaaacaatacagcgacaaaaagataaaactaaacttcgacagtccgacattggcaaagggctgggacgcaaataaggaaatcgataactctacgataattatgcgtaagttcaataatgatcgaggtgattatgattatttcttaggcatttggaacaaaagcaccccggccaacgaaaagataattccactggaggataacggtctgttcgaaaaaatgcagtacaaattatatccggatccaagcaagatgcttccaaagcagtttctgtctaaaatttggaaagctaagcatccgaccaccccagaatttgacaagaaatataaggaaggccgccataagaaaggtcccgattttgaaaaagaattcttgcacgaactgattgattgctttaaacatggcttagtcaatcacgatgaaaagtatcaagatgtttttggattcaatttgagaaacacagaagactacaattcctacactgagtttctcgaagatgtggaacgatgtaattataatctgagctttaacaaaatcgcggacacctcgaatctgattaacgatggtaaactttatgttttccagatctggagcaaggatttctctattgacagcaaaggcaccaaaaacctgaacaccatttactttgaaagtctcttcagcgaagaaaatatgattgagaaaatgtttaaacttagcggtgaagctgaaatattctatcgcccggcaagcctgaactattgcgaagacattatcaaaaagggtcatcaccacgctgaactgaaagataaatttgattatcctatcataaaagataaacgctatagccaggataaatttttttttcatgttcctatggtcattaactacaaatcagaaaaactgaactctaaaagcctcaataatcgaaccaatgaaaaccttgggcagtttacccatataattggaattgatcgcggagagcgtcatttaatctacctgaccgtagtcgatgtatcgaccggcgagatcgtcgagcagaagcacttagacgagattatcaacactgataccaaaggtgttgagcataagacgcactatctaaacaagctggaggaaaaatcgaaaacccgtgataatgaacgtaagagttgggaggcaattgaaacgattaaagaactgaaggagggttatatcagccacgtaatcaatgaaattcaaaaactgcaggaaaaatacaacgccctgatcgttatggaaaatctgaattacggtttcaaaaattctcgcatcaaagtggaaaaacaggtatatcagaagttcgagacggcattaattaaaaagtttaattacatcattgacaaaaaagatccggaaacttatattcatggctatcagctgacgaacccgatcaccacactggataaaattggtaaccagtctggtatcgtgctttacatccctgcctggaataccagtaaaatcgatccggtaacgggattcgtcaaccttctatatgcagatgacctcaaatataagaatcaggaacaggccaagtcttttattcagaaaatcgataacatttactttgagaatggggaattcaaatttgatattgatttttctaaatggaacaatcgttatagtatatctaagacgaaatggacgctcacctcgtacggaacccgaatccagacattccgcaatccgcagaagaacaataaatgggacagcgccgagtatgatctcactgaagaattcaaattgattctgaacattgacggtaccctgaaaagccaggatgtcgaaacctataaaaaatttatgtctctgttcaagctgatgctgcaacttaggaactctgttaccggcactgatatcgattatatgatctcccctgtcactgataaaacaggtacgcatttcgattcgcgcgaaaatatcaaaaatctgcccgcagatgccgacgccaatggggcgtacaatattgcacgcaagggtatcatggcgatcgaaaacattatgaatggtatcagcgacccgctgaaaatctcaaacgaagattatttgaaatatatccaaaaccagcaggaataa

SEQ ID NO: 52 - DNA, 3923 bp, Artificial Sequence
  Description of Artificial Sequence: Synthetic polynucleotide
atgacccagttcgaaggtttcaccaacctgtaccaggtttctaaaaccctgcgtttcgaactgatcccgcagggtaaaaccctgaaacacatccaggaacagggtttcatcgaagaagacaaagcgcgtaacgaccactacaaagaactgaaaccgatcatcgaccgtatctacaaaacctacgcggaccagtgcctgcagctggttcagctggactgggaaaacctgtctgcggcgatcgactcttaccgtaaagaaaaaaccgaagaaacccgtaacgcgctgatcgaagaacaggcgacctaccgtaacgcgatccacgactacttcatcggtcgtaccgacaacctgaccgacgcgatcaacaaacgtcacgcggaaatctacaaaggtctgttcaaagcggaactgttcaacggtaaagttctgaaacagctgggtaccgttaccaccaccgaacacgaaaacgcgctgctgcgttctttcgacaaattcaccacctacttctctggtttctacgaaaaccgtaaaaacgttttctctgcggaagacatctctaccgcgatcccgcaccgtatcgttcaggacaacttcccgaaattcaaagaaaactgccacatcttcacccgtctgatcaccgcggttccgtctctgcgtgaacacttcgaaaacgttaaaaaagcgatcggtatcttcgtttctacctctatcgaagaagttttctctttcccgttctacaaccagctgctgacccagacccagatcgacctgtacaaccagctgctgggtggtatctctcgtgaagcgggtaccgaaaaaatcaaaggtctgaacgaagttctgaacctggcgatccagaaaaacgacgaaaccgcgcacatcatcgcgtctctgccgcaccgtttcatcccgctgttcaaacagatcctgtctgaccgtaacaccctgtctttcatcctggaagaattcaaatctgacgaagaagttatccagtctttctgcaaatacaaaaccctgctgcgtaacgaaaacgttctggaaaccgcggaagcgctgttcaacgaactgaactctatcgacctgacccacatcttcatctctcacaaaaaactggaaaccatctcttctgcgctgtgcgaccactgggacaccctgcgtaacgcgctgtacgaacgtcgtatctctgaactgaccggtaaaatcaccaaatctgcgaaagaaaaagttcagcgttctctgaaacacgaagacatcaacctgcaggaaatcatctctgcggcgggtaaagaactgtctgaagcgttcaaacagaaaacctctgaaatcctgtctcacgcgcacgcggcgctggaccagccgctgccgaccaccctgaaaaaacaggaagaaaaagaaatcctgaaatctcagctggactctctgctgggtctgtaccacctgctggactggttcgcggttgacgaatctaacgaagttgacccggaattctctgcgcgtctgaccggtatcaaactggaaatggaaccgtctctgtctttctacaacaaagcgcgtaactacgcgaccaaaaaaccgtactctgttgaaaaattcaaactgaacttccagatgccgaccctggcgtctggttgggacgttaacaaagaaaaaaacaacggtgcgatcctgttcgttaaaaacggtctgtactacctgggtatcatgccgaaacagaaaggtcgttacaaagcgctgtctttcgaaccgaccgaaaaaacctctgaaggtttcgacaaaatgtactacgactacttcccggacgcggcgaaaatgatcccgaaatgctctacccagctgaaagcggttaccgcgcacttccagacccacaccaccccgatcctgctgtctaacaacttcatcgaaccgctggaaatcaccaaagaaatctacgacctgaacaacccggaaaaagaaccgaaaaaattccagaccgcgtacgcgaaaaaaaccggtgaccagaaaggttaccgtgaagcgctgtgcaaatggatcgacttcacccgtgacttcctgtctaaatacaccaaaaccacctctatcgacctgtcttctctgcgtccgtcttctcagtacaaagacctgggtgaatactacgcggaactgaacccgctgctgtaccacatctctttccagcgtatcgcggaaaaagaaatcatggacgcggttgaaaccggtaaactgtacctgttccagatctacaacaaagacttcgcgaaaggtcaccacggtaaaccgaacctgcacaccctgtactggaccggtctgttctctccggaaaacctggcgaaaacctctatcaaactgaacggtcaggcggaactgttctaccgtccgaaatctcgtatgaaacgtatggcgcaccgtctgggtgaaaaaatgctgaacaaaaaactgaaagaccagaaaaccccgatcccggacaccctgtaccaggaactgtacgactacgttaaccaccgtctgtctcacgacctgtctgacgaagcgcgtgcgctgctgccgaacgttatcaccaaagaagtttctcacgaaatcatcaaagaccgtcgtttcacctctgacaaattcttcttccacgttccgatcaccctgaactaccaggcggcgaactctccgtctaaattcaaccagcgtgttaacgcgtacctgaaagaacacccggaaaccccgatcatcggtatcgaccgtggtgaacgtaacctgatctacatcaccgttatcgactctaccggtaaaatcctggaacagcgttctctgaacaccatccagcagttcgactaccagaaaaaactggacaaccgtgaaaaagaacgtgttgcggcgcgtcaggcgtggtctgttgttggtaccatcaaagacctgaaacagggttacctgtctcaggttatccacgaaatcgttgacctgatgatccactaccaggcggttgttgttctggaaaacctgaacttcggtttcaaatctaaacgtaccggtatcgcggaaaaagcggtttaccagcagttcgaaaaaatgctgatcgacaaactgaactgcctggttctgaaagactacccggcggaaaaagttggtggtgttctgaacccgtaccagctgaccgaccagttcacctctttcgcgaaaatgggtacccagtctggtttcctgttctacgttccggcgccgtacacctctaaaatcgacccgctgaccggtttcgttgacccgttcgtttggaaaaccatcaaaaaccacgaatctcgtaaacacttcctggaaggtttcgacttcctgcactacgacgttaaaaccggtgacttcatcctgcacttcaaaatgaaccgtaacctgtctttccagcgtggtctgccgggtttcatgccggcgtgggacatcgttttcgaaaaaaacgaaacccagttcgacgcgaaaggtaccccgttcatcgcgggtaaacgtatcgttccggttatcgaaaaccaccgtttcaccggtcgttaccgtgacctgtacccggcgaacgaactgatcgcgctgctggaagaaaaaggtatcgttttccgtgacggttctaacatcctgccgaaactgctggaaaacgacgactctcacgcgatcgacaccatggttgcgctgatccgttctgttctgcagatgcgtaactctaacgcggcgaccggtgaagactacatcaactctccggttcgtgacctgaacggtgtttgcttcgactctcgtttccagaacccggaatggccgatggacgcggacgcgaacggtgcgtaccacatcgcgctgaaaggtcagctgctgctgaaccacctgaaagaatctaaagacctgaaactgcagaacggtatctctaaccaggactggctggcgtacatccaggaactgcgtaacta

SEQ ID NO: 53 - DNA, 3390 bp, Artificial Sequence
  Description of Artificial Sequence: Synthetic polynucleotide
atggcggttaaatctatcaaagttaaactgcgtctggacgacatgccggaaatccgtgcgggtctgtggaaactgcacaaagaagttaacgcgggtgttcgttactacaccgaatggctgtctctgctgcgtcaggaaaacctgtaccgtcgttctccgaacggtgacggtgaacaggaatgcgacaaaaccgcggaagaatgcaaagcggaactgctggaacgtctgcgtgcgcgtcaggttgaaaacggtcaccgtggtccggcgggttctgacgacgaactgctgcagctggcgcgtcagctgtacgaactgctggttccgcaggcgatcggtgcgaaaggtgacgcgcagcagatcgcgcgtaaattcctgtctccgctggcggacaaagacgcggttggtggtctgggtatcgcgaaagcgggtaacaaaccgcgttgggttcgtatgcgtgaagcgggtgaaccgggttgggaagaagaaaaagaaaaagcggaaacccgtaaatctgcggaccgtaccgcggacgttctgcgtgcgctggcggacttcggtctgaaaccgctgatgcgtgtttacaccgactctgaaatgtcttctgttgaatggaaaccgctgcgtaaaggtcaggcggttcgtacctgggaccgtgacatgttccagcaggcgatcgaacgtatgatgtcttgggaatcttggaaccagcgtgttggtcaggaatacgcgaaactggttgaacagaaaaaccgtttcgaacagaaaaacttcgttggtcaggaacacctggttcacctggttaaccagctgcagcaggacatgaaagaagcgtctccgggtctggaatctaaagaacagaccgcgcactacgttaccggtcgtgcgctgcgtggttctgacaaagttttcgaaaaatggggtaaactggcgccggacgcgccgttcgacctgtacgacgcggaaatcaaaaacgttcagcgtcgtaacacccgtcgtttcggttctcacgacctgttcgcgaaactggcggaaccggaataccaggcgctgtggcgtgaagacgcgtctttcctgacccgttacgcggtttacaactctatcctgcgtaaactgaaccacgcgaaaatgttcgcgaccttcaccctgccggacgcgaccgcgcacccgatctggacccgtttcgacaaactgggtggtaacctgcaccagtacaccttcctgttcaacgaattcggtgaacgtcgtcacgcgatccgtttccacaaactgctgaaagttgaaaacggtgttgcgcgtgaagttgacgacgttaccgttccgatctctatgtctgaacagctggacaacctgctgccgcgtgacccgaacgaaccgatcgcgctgtacttccgtgactacggtgcggaacagcacttcaccggtgaattcggtggtgcgaaaatccagtgccgtcgtgaccagctggcgcacatgcaccgtcgtcgtggtgcgcgtgacgtttacctgaacgtttctgttcgtgttcagtctcagtctgaagcgcgtggtgaacgtcgtccgccgtacgcggcggttttccgtctggttggtgacaaccaccgtgcgttcgttcacttcgacaaactgtctgactacctggcggaacacccggacgacggtaaactgggttctgaaggtctgctgtctggtctgcgtgttatgtctgttgacctgggtctgcgtacctctgcgtctatctctgttttccgtgttgcgcgtaaagacgaactgaaaccgaactctaaaggtcgtgttccgttcttcttcccgatcaaaggtaacgacaacctggttgcggttcacgaacgttctcagctgctgaaactgccgggtgaaaccgaatctaaagacctgcgtgcgatccgtgaagaacgtcagcgtaccctgcgtcagctgcgtacccagctggcgtacctgcgtctgctggttcgttgcggttctgaagacgttggtcgtcgtgaacgttcttgggcgaaactgatcgaacagccggttgacgcggcgaaccacatgaccccggactggcgtgaagcgttcgaaaacgaactgcagaaactgaaatctctgcacggtatctgctctgacaaagaatggatggacgcggtttacgaatctgttcgtcgtgtttggcgtcacatgggtaaacaggttcgtgactggcgtaaagacgttcgttctggtgaacgtccgaaaatccgtggttacgcgaaagacgttgttggtggtaactctatcgaacagatcgaatacctggaacgtcagtacaaattcctgaaatcttggtctttcttcggtaaagtttctggtcaggttatccgtgcggaaaaaggttctcgtttcgcgatcaccctgcgtgaacacatcgaccacgcgaaagaagaccgtctgaaaaaactggcggaccgtatcatcatggaagcgctgggttacgtttacgcgctggacgaacgtggtaaaggtaaatgggttgcgaaatacccgccgtgccagctgatcctgctggaagaactgtctgaataccagttcaacaacgaccgtccgccgtctgaaaacaaccagctgatgcagtggtctcaccgtggtgttttccaggaactgatcaaccaggcgcaggttcacgacctgctggttggtaccatgtacgcggcgttctcttctcgtttcgacgcgcgtaccggtgcgccgggtatccgttgccgtcgtgttccggcgcgttgcacccaggaacacaacccggaaccgttcccgtggtggctgaacaaattcgttgttgaacacaccctggacgcgtgcccgctgcgtgcggacgacctgatcccgaccggtgaaggtgaaatcttcgtttctccgttctctgcggaagaaggtgacttccaccagatccacgcggacctgaacgcggcgcagaacctgcagcagcgtctgtggtctgacttcgacatctctcagatccgtctgcgttgcgactggggtgaagttgacggtgaactggttctgatcccgcgtctgaccggtaaacgtaccgcggactcttactctaacaaagttttctacaccaacaccggtgttacctactacgaacgtgaacgtggtaaaaaacgtcgtaaagttttcgcgcaggaaaaactgtctgaagaagaagcggaactgctggttgaagcggacgaagcgcgtgaaaaatctgttgttctgatgcgtgacccgtctggtatcatcaaccgtggtaactggacccgtcagaaagaattctggtctatggttaaccagcgtatcgaaggttacctggttaaacagatccgttctcgtgttccgctgcaggactctgcgtgcgaaaacaccggtgacatctaa

SEQ ID NO: 54 - DNA, 3327 bp, Artificial Sequence
  Description of Artificial Sequence: Synthetic polynucleotide
atggcgacccgttctttcatcctgaaaatcgaaccgaacgaagaagttaaaaaaggtctgtggaaaacccacgaagttctgaaccacggtatcgcgtactacatgaacatcctgaaactgatccgtcaggaagcgatctacgaacaccacgaacaggacccgaaaaacccgaaaaaagtttctaaagcggaaatccaggcggaactgtgggacttcgttctgaaaatgcagaaatgcaactctttcacccacgaagttgacaaagacgttgttttcaacatcctgcgtgaactgtacgaagaactggttccgtcttctgttgaaaaaaaaggtgaagcgaaccagctgtctaacaaattcctgtacccgctggttgacccgaactctcagtctggtaaaggtaccgcgtcttctggtcgtaaaccgcgttggtacaacctgaaaatcgcgggtgacccgtcttgggaagaagaaaaaaaaaaatgggaagaagacaaaaaaaaagacccgctggcgaaaatcctgggtaaactggcggaatacggtctgatcccgctgttcatcccgttcaccgactctaacgaaccgatcgttaaagaaatcaaatggatggaaaaatctcgtaaccagtctgttcgtcgtctggacaaagacatgttcatccaggcgctggaacgtttcctgtcttgggaatcttggaacctgaaagttaaagaagaatacgaaaaagttgaaaaagaacacaaaaccctggaagaacgtatcaaagaagacatccaggcgttcaaatctctggaacagtacgaaaaagaacgtcaggaacagctgctgcgtgacaccctgaacaccaacgaataccgtctgtctaaacgtggtctgcgtggttggcgtgaaatcatccagaaatggctgaaaatggacgaaaacgaaccgtctgaaaaatacctggaagttttcaaagactaccagcgtaaacacccgcgtgaagcgggtgactactctgtttacgaattcctgtctaaaaaagaaaaccacttcatctggcgtaaccacccggaatacccgtacctgtacgcgaccttctgcgaaatcgacaaaaaaaaaaaagacgcgaaacagcaggcgaccttcaccctggcggacccgatcaaccacccgctgtgggttcgtttcgaagaacgttctggttctaacctgaacaaataccgtatcctgaccgaacagctgcacaccgaaaaactgaaaaaaaaactgaccgttcagctggaccgtctgatctacccgaccgaatctggtggttgggaagaaaaaggtaaagttgacatcgttctgctgccgtctcgtcagttctacaaccagatcttcctggacatcgaagaaaaaggtaaacacgcgttcacctacaaagacgaatctatcaaattcccgctgaaaggtaccctgggtggtgcgcgtgttcagttcgaccgtgaccacctgcgtcgttacccgcacaaagttgaatctggtaacgttggtcgtatctacttcaacatgaccgttaacatcgaaccgaccgaatctccggtttctaaatctctgaaaatccaccgtgacgacttcccgaaattcgttaacttcaaaccgaaagaactgaccgaatggatcaaagactctaaaggtaaaaaactgaaatctggtatcgaatctctggaaatcggtctgcgtgttatgtctatcgacctgggtcagcgtcaggcggcggcggcgtctatcttcgaagttgttgaccagaaaccggacatcgaaggtaaactgttcttcccgatcaaaggtaccgaactgtacgcggttcaccgtgcgtctttcaacatcaaactgccgggtgaaaccctggttaaatctcgtgaagttctgcgtaaagcgcgtgaagacaacctgaaactgatgaaccagaaactgaacttcctgcgtaacgttctgcacttccagcagttcgaagacatcaccgaacgtgaaaaacgtgttaccaaatggatctctcgtcaggaaaactctgacgttccgctggtttaccaggacgaactgatccagatccgtgaactgatgtacaaaccgtacaaagactgggttgcgttcctgaaacagctgcacaaacgtctggaagttgaaatcggtaaagaagttaaacactggcgtaaatctctgtctgacggtcgtaaaggtctgtacggtatctctctgaaaaacatcgacgaaatcgaccgtacccgtaaattcctgctgcgttggtctctgcgtccgaccgaaccgggtgaagttcgtcgtctggaaccgggtcagcgtttcgcgatcgaccagctgaaccacctgaacgcgctgaaagaagaccgtctgaaaaaaatggcgaacaccatcatcatgcacgcgctgggttactgctacgacgttcgtaaaaaaaaatggcaggcgaaaaacccggcgtgccagatcatcctgttcgaagacctgtctaactacaacccgtacgaagaacgttctcgtttcgaaaactctaaactgatgaaatggtctcgtcgtgaaatcccgcgtcaggttgcgctgcagggtgaaatctacggtctgcaggttggtgaagttggtgcgcagttctcttctcgtttccacgcgaaaaccggttctccgggtatccgttgctctgttgttaccaaagaaaaactgcaggacaaccgtttcttcaaaaacctgcagcgtgaaggtcgtctgaccctggacaaaatcgcggttctgaaagaaggtgacctgtacccggacaaaggtggtgaaaaattcatctctctgtctaaagaccgtaaactggttaccacccacgcggacatcaacgcggcgcagaacctgcagaaacgtttctggacccgtacccacggtttctacaaagtttactgcaaagcgtaccaggttgacggtcagaccgtttacatcccggaatctaaagaccagaaacagaaaatcatcgaagaattcggtgaaggttacttcatcctgaaagacggtgtttacgaatggggtaacgcgggtaaactgaaaatcaaaaaaggttcttctaaacagtcttcttctgaactggttgactctgacatcctgaaagactctttcgacctggcgtctgaactgaaaggtgaaaaactgatgctgtaccgtgacccgtctggtaacgttttcccgtctgacaaatggatggcggcgggtgttttcttcggtaaactggaacgtatcctgatctctaaactgaccaaccagtactctatctctaccatcgaagacgactcttctaaacagtctatgtaa

SEQ ID NO: 55 - DNA, 3450 bp, Artificial Sequence
  Description of Artificial Sequence: Synthetic polynucleotide
atgccgacccgtaccatcaacctgaaactggttctgggtaaaaacccggaaaacgcgaccctgcgtcgtgcgctgttctctacccaccgtctggttaaccaggcgaccaaacgtatcgaagaattcctgctgctgtgccgtggtgaagcgtaccgtaccgttgacaacgaaggtaaagaagcggaaatcccgcgtcacgcggttcaggaagaagcgctggcgttcgcgaaagcggcgcagcgtcacaacggttgcatctctacctacgaagaccaggaaatcctggacgttctgcgtcagctgtacgaacgtctggttccgtctgttaacgaaaacaacgaagcgggtgacgcgcaggcggcgaacgcgtgggtttctccgctgatgtctgcggaatctgaaggtggtctgtctgtttacgacaaagttctggacccgccgccggtttggatgaaactgaaagaagaaaaagcgccgggttgggaagcggcgtctcagatctggatccagtctgacgaaggtcagtctctgctgaacaaaccgggttctccgccgcgttggatccgtaaactgcgttctggtcagccgtggcaggacgacttcgtttctgaccagaaaaaaaaacaggacgaactgaccaaaggtaacgcgccgctgatcaaacagctgaaagaaatgggtctgctgccgctggttaacccgttcttccgtcacctgctggacccggaaggtaaaggtgtttctccgtgggaccgtctggcggttcgtgcggcggttgcgcacttcatctcttgggaatcttggaaccaccgtacccgtgcggaatacaactctctgaaactgcgtcgtgacgaattcgaagcggcgtctgacgaattcaaagacgacttcaccctgctgcgtcagtacgaagcgaaacgtcactctaccctgaaatctatcgcgctggcggacgactctaacccgtaccgtatcggtgttcgttctctgcgtgcgtggaaccgtgttcgtgaagaatggatcgacaaaggtgcgaccgaagaacagcgtgttaccatcctgtctaaactgcagacccagctgcgtggtaaattcggtgacccggacctgttcaactggctggcgcaggaccgtcacgttcacctgtggtctccgcgtgactctgttaccccgctggttcgtatcaacgcggttgacaaagttctgcgtcgtcgtaaaccgtacgcgctgatgaccttcgcgcacccgcgtttccacccgcgttggatcctgtacgaagcgccgggtggttctaacctgcgtcagtacgcgctggactgcaccgaaaacgcgctgcacatcaccctgccgctgctggttgacgacgcgcacggtacctggatcgaaaaaaaaatccgtgttccgctggcgccgtctggtcagatccaggacctgaccctggaaaaactggaaaaaaaaaaaaaccgtctgtactaccgttctggtttccagcagttcgcgggtctggcgggtggtgcggaagttctgttccaccgtccgtacatggaacacgacgaacgttctgaagaatctctgctggaacgtccgggtgcggtttggttcaaactgaccctggacgttgcgacccaggcgccgccgaactggctggacggtaaaggtcgtgttcgtaccccgccggaagttcaccacttcaaaaccgcgctgtctaacaaatctaaacacacccgtaccctgcagccgggtctgcgtgttctgtctgttgacctgggtatgcgtaccttcgcgtcttgctctgttttcgaactgatcgaaggtaaaccggaaaccggtcgtgcgttcccggttgcggacgaacgttctatggactctccgaacaaactgtgggcgaaacacgaacgttctttcaaactgaccctgccgggtgaaaccccgtctcgtaaagaagaagaagaacgttctatcgcgcgtgcggaaatctacgcgctgaaacgtgacatccagcgtctgaaatctctgctgcgtctgggtgaagaagacaacgacaaccgtcgtgacgcgctgctggaacagttcttcaaaggttggggtgaagaagacgttgttccgggtcaggcgttcccgcgttctctgttccagggtctgggtgcggcgccgttccgttctaccccggaactgtggcgtcagcactgccagacctactacgacaaagcggaagcgtgcctggcgaaacacatctctgactggcgtaaacgtacccgtccgcgtccgacctctcgtgaaatgtggtacaaaacccgttcttaccacggtggtaaatctatctggatgctggaatacctggacgcggttcgtaaactgctgctgtcttggtctctgcgtggtcgtacctacggtgcgatcaaccgtcaggacaccgcgcgtttcggttctctggcgtctcgtctgctgcaccacatcaactctctgaaagaagaccgtatcaaaaccggtgcggactctatcgttcaggcggcgcgtggttacatcccgctgccgcacggtaaaggttgggaacagcgttacgaaccgtgccagctgatcctgttcgaagacctggcgcgttaccgtttccgtgttgaccgtccgcgtcgtgaaaactctcagctgatgcagtggaaccaccgtgcgatcgttgcggaaaccaccatgcaggcggaactgtacggtcagatcgttgaaaacaccgcggcgggtttctcttctcgtttccacgcggcgaccggtgcgccgggtgttcgttgccgtttcctgctggaacgtgacttcgacaacgacctgccgaaaccgtacctgctgcgtgaactgtcttggatgctgggtaacaccaaagttgaatctgaagaagaaaaactgcgtctgctgtctgaaaaaatccgtccgggttctctggttccgtgggacggtggtgaacagttcgcgaccctgcacccgaaacgtcagaccctgtgcgttatccacgcggacatgaacgcggcgcagaacctgcagcgtcgtttcttcggtcgttgcggtgaagcgttccgtctggtttgccagccgcacggtgacgacgttctgcgtctggcgtctaccccgggtgcgcgtctgctgggtgcgctgcagcagctggaaaacggtcagggtgcgttcgaactggttcgtgacatgggttctacctctcagatgaaccgtttcgttatgaaatctctgggtaaaaaaaaaatcaaaccgctgcaggacaacaacggtgacgacgaactggaagacgttctgtctgttctgccggaagaagacgacaccggtcgtatcaccgttttccgtgactcttctggtatcttcttcccgtgcaacgtttggatcccggcgaaacagttctggccggcggttcgtgcgatgatctggaaagttatggcgtctcactctctgggttaa

SEQ ID NO: 56 - DNA, 3759 bp, Artificial Sequence
  Description of Artificial Sequence: Synthetic polynucleotide
atgaccaaactgcgtcaccgtcagaaaaaactgacccacgactgggcgggttctaaaaaacgtgaagttctgggttctaacggtaaactgcagaacccgctgctgatgccggttaaaaaaggtcaggttaccgaattccgtaaagcgttctctgcgtacgcgcgtgcgaccaaaggtgaaatgaccgacggtcgtaaaaacatgttcacccactctttcgaaccgttcaaaaccaaaccgtctctgcaccagtgcgaactggcggacaaagcgtaccagtctctgcactcttacctgccgggttctctggcgcacttcctgctgtctgcgcacgcgctgggtttccgtatcttctctaaatctggtgaagcgaccgcgttccaggcgtcttctaaaatcgaagcgtacgaatctaaactggcgtctgaactggcgtgcgttgacctgtctatccagaacctgaccatctctaccctgttcaacgcgctgaccacctctgttcgtggtaaaggtgaagaaacctctgcggacccgctgatcgcgcgtttctacaccctgctgaccggtaaaccgctgtctcgtgacacccagggtccggaacgtgacctggcggaagttatctctcgtaaaatcgcgtcttctttcggtacctggaaagaaatgaccgcgaacccgctgcagtctctgcagttcttcgaagaagaactgcacgcgctggacgcgaacgtttctctgtctccggcgttcgacgttctgatcaaaatgaacgacctgcagggtgacctgaaaaaccgtaccatcgttttcgacccggacgcgccggttttcgaatacaacgcggaagacccggcggacatcatcatcaaactgaccgcgcgttacgcgaaagaagcggttatcaaaaaccagaacgttggtaactacgttaaaaacgcgatcaccaccaccaacgcgaacggtctgggttggctgctgaacaaaggtctgtctctgctgccggtttctaccgacgacgaactgctggaattcatcggtgttgaacgttctcacccgtcttgccacgcgctgatcgaactgatcgcgcagctggaagcgccggaactgttcgaaaaaaacgttttctctgacacccgttctgaagttcagggtatgatcgactctgcggtttctaaccacatcgcgcgtctgtcttcttctcgtaactctctgtctatggactctgaagaactggaacgtctgatcaaatctttccagatccacaccccgcactgctctctgttcatcggtgcgcagtctctgtctcagcagctggaatctctgccggaagcgctgcagtctggtgttaactctgcggacatcctgctgggttctacccagtacatgctgaccaactctctggttgaagaatctatcgcgacctaccagcgtaccctgaaccgtatcaactacctgtctggtgttgcgggtcagatcaacggtgcgatcaaacgtaaagcgatcgacggtgaaaaaatccacctgccggcggcgtggtctgaactgatctctctgccgttcatcggtcagccggttatcgacgttgaatctgacctggcgcacctgaaaaaccagtaccagaccctgtctaacgaattcgacaccctgatctctgcgctgcagaaaaacttcgacctgaacttcaacaaagcgctgctgaaccgtacccagcacttcgaagcgatgtgccgttctaccaaaaaaaacgcgctgtctaaaccggaaatcgtttcttaccgtgacctgctggcgcgtctgacctcttgcctgtaccgtggttctctggttctgcgtcgtgcgggtatcgaagttctgaaaaaacacaaaatcttcgaatctaactctgaactgcgtgaacacgttcacgaacgtaaacacttcgttttcgtttctccgctggaccgtaaagcgaaaaaactgctgcgtctgaccgactctcgtccggacctgctgcacgttatcgacgaaatcctgcagcacgacaacctggaaaacaaagaccgtgaatctctgtggctggttcgttctggttacctgctggcgggtctgccggaccagctgtcttcttctttcatcaacctgccgatcatcacccagaaaggtgaccgtcgtctgatcgacctgatccagtacgaccagatcaaccgtgacgcgttcgttatgctggttacctctgcgttcaaatctaacctgtctggtctgcagtaccgtgcgaacaaacagtctttcgttgttacccgtaccctgtctccgtacctgggttctaaactggtttacgttccgaaagacaaagactggctggttccgtctcagatgttcgaaggtcgtttcgcggacatcctgcagtctgactacatggtttggaaagacgcgggtcgtctgtgcgttatcgacaccgcgaaacacctgtctaacatcaaaaaatctgttttctcttctgaagaagttctggcgttcctgcgtgaactgccgcaccgtaccttcatccagaccgaagttcgtggtctgggtgttaacgttgacggtatcgcgttcaacaacggtgacatcccgtctctgaaaaccttctctaactgcgttcaggttaaagtttctcgtaccaacacctctctggttcagaccctgaaccgttggttcgaaggtggtaaagtttctccgccgtctatccagttcgaacgtgcgtactacaaaaaagacgaccagatccacgaagacgcggcgaaacgtaaaatccgtttccagatgccggcgaccgaactggttcacgcgtctgacgacgcgggttggaccccgtcttacctgctgggtatcgacccgggtgaatacggtatgggtctgtctctggtttctatcaacaacggtgaagttctggactctggtttcatccacatcaactctctgatcaacttcgcgtctaaaaaatctaaccaccagaccaaagttgttccgcgtcagcagtacaaatctccgtacgcgaactacctggaacagtctaaagactctgcggcgggtgacatcgcgcacatcctggaccgtctgatctacaaactgaacgcgctgccggttttcgaagcgctgtctggtaactctcagtctgcggcggaccaggtttggaccaaagttctgtctttctacacctggggtgacaacgacgcgcagaactctatccgtaaacagcactggttcggtgcgtctcactgggacatcaaaggtatgctgcgtcagccgccgaccgaaaaaaaaccgaaaccgtacatcgcgttcccgggttctcaggtttcttcttacggtaactctcagcgttgctcttgctgcggtcgtaacccgatcgaacagctgcgtgaaatggcgaaagacacctctatcaaagaactgaaaatccgtaactctgaaatccagctgttcgacggtaccatcaaactgttcaacccggacccgtctaccgttatcgaacgtcgtcgtcacaacctgggtccgtctcgtatcccggttgcggaccgtaccttcaaaaacatctctccgtcttctctggaattcaaagaactgatcaccatcgtttctcgttctatccgtcactctccggaattcatcgcgaaaaaacgtggtatcggttctgaatacttctgcgcgtactctgactgcaactcttctctgaactctgaagcgaacgcggcggcgaacgttgcgcagaaattccagaaacagctgttcttcgaactgtaa

SEQ ID NO: 57 - DNA, 3864 bp, Artificial Sequence
  Description of Artificial Sequence: Synthetic polynucleotide
atgaaacgtatcctgaactctctgaaagttgcggcgctgcgtctgctgttccgtggtaaaggttctgaactggttaaaaccgttaaatacccgctggtttctccggttcagggtgcggttgaagaactggcggaagcgatccgtcacgacaacctgcacctgttcggtcagaaagaaatcgttgacctgatggaaaaagacgaaggtacccaggtttactctgttgttgacttctggctggacaccctgcgtctgggtatgttcttctctccgtctgcgaacgcgctgaaaatcaccctgggtaaattcaactctgaccaggtttctccgttccgtaaagttctggaacagtctccgttcttcctggcgggtcgtctgaaagttgaaccggcggaacgtatcctgtctgttgaaatccgtaaaatcggtaaacgtgaaaaccgtgttgaaaactacgcggcggacgttgaaacctgcttcatcggtcagctgtcttctgacgaaaaacagtctatccagaaactggcgaacgacatctgggactctaaagaccacgaagaacagcgtatgctgaaagcggacttcttcgcgatcccgctgatcaaagacccgaaagcggttaccgaagaagacccggaaaacgaaaccgcgggtaaacagaaaccgctggaactgtgcgtttgcctggttccggaactgtacacccgtggtttcggttctatcgcggacttcctggttcagcgtctgaccctgctgcgtgacaaaatgtctaccgacaccgcggaagactgcctggaatacgttggtatcgaagaagaaaaaggtaacggtatgaactctctgctgggtaccttcctgaaaaacctgcagggtgacggtttcgaacagatcttccagttcatgctgggttcttacgttggttggcagggtaaagaagacgttctgcgtgaacgtctggacctgctggcggaaaaagttaaacgtctgccgaaaccgaaattcgcgggtgaatggtctggtcaccgtatgttcctgcacggtcagctgaaatcttggtcttctaacttcttccgtctgttcaacgaaacccgtgaactgctggaatctatcaaatctgacatccagcacgcgaccatgctgatctcttacgttgaagaaaaaggtggttaccacccgcagctgctgtctcagtaccgtaaactgatggaacagctgccggcgctgcgtaccaaagttctggacccggaaatcgaaatgacccacatgtctgaagcggttcgttcttacatcatgatccacaaatctgttgcgggtttcctgccggacctgctggaatctctggaccgtgacaaagaccgtgaattcctgctgtctatcttcccgcgtatcccgaaaatcgacaaaaaaaccaaagaaatcgttgcgtgggaactgccgggtgaaccggaagaaggttacctgttcaccgcgaacaacctgttccgtaacttcctggaaaacccgaaacacgttccgcgtttcatggcggaacgtatcccggaagactggacccgtctgcgttctgcgccggtttggttcgacggtatggttaaacagtggcagaaagttgttaaccagctggttgaatctccgggtgcgctgtaccagttcaacgaatctttcctgcgtcagcgtctgcaggcgatgctgaccgtttacaaacgtgacctgcagaccgaaaaattcctgaaactgctggcggacgtttgccgtccgctggttgacttcttcggtctgggtggtaacgacatcatcttcaaatcttgccaggacccgcgtaaacagtggcagaccgttatcccgctgtctgttccggcggacgtttacaccgcgtgcgaaggtctggcgatccgtctgcgtgaaaccctgggtttcgaatggaaaaacctgaaaggtcacgaacgtgaagacttcctgcgtctgcaccagctgctgggtaacctgctgttctggatccgtgacgcgaaactggttgttaaactggaagactggatgaacaacccgtgcgttcaggaatacgttgaagcgcgtaaagcgatcgacctgccgctggaaatcttcggtttcgaagttccgatcttcctgaacggttacctgttctctgaactgcgtcagctggaactgctgctgcgtcgtaaatctgttatgacctcttactctgttaaaaccaccggttctccgaaccgtctgttccagctggtttacctgccgctgaacccgtctgacccggaaaaaaaaaactctaacaacttccaggaacgtctggacaccccgaccggtctgtctcgtcgtttcctggacctgaccctggacgcgttcgcgggtaaactgctgaccgacccggttacccaggaactgaaaaccatggcgggtttctacgaccacctgttcggtttcaaactgccgtgcaaactggcggcgatgtctaaccacccgggttcttcttctaaaatggttgttctggcgaaaccgaaaaaaggtgttgcgtctaacatcggtttcgaaccgatcccggacccggcgcacccggttttccgtgttcgttcttcttggccggaactgaaatacctggaaggtctgctgtacctgccggaagacaccccgctgaccatcgaactggcggaaacctctgtttcttgccagtctgtttcttctgttgcgttcgacctgaaaaacctgaccaccatcctgggtcgtgttggtgaattccgtgttaccgcggaccagccgttcaaactgaccccgatcatcccggaaaaagaagaatctttcatcggtaaaacctacctgggtctggacgcgggtgaacgttctggtgttggtttcgcgatcgttaccgttgacggtgacggttacgaagttcagcgtctgggtgttcacgaagacacccagctgatggcgctgcagcaggttgcgtctaaatctctgaaagaaccggttttccagccgctgcgtaaaggtaccttccgtcagcaggaacgtatccgtaaatctctgcgtggttgctactggaacttctaccacgcgctgatgatcaaataccgtgcgaaagttgttcacgaagaatctgttggttcttctggtctggttggtcagtggctgcgtgcgttccagaaagacctgaaaaaagcggacgttctgccgaaaaaaggtggtaaaaacggtgttgacaaaaaaaaacgtgaatcttctgcgcaggacaccctgtggggtggtgcgttctctaaaaaagaagaacagcagatcgcgttcgaagttcaggcggcgggttcttctcagttctgcctgaaatgcggttggtggttccagctgggtatgcgtgaagttaaccgtgttcaggaatctggtgttgttctggactggaaccgttctatcgttaccttcctgatcgaatcttctggtgaaaaagtttacggtttctctccgcagcagctggaaaaaggtttccgtccggacatcgaaaccttcaaaaaaatggttcgtgacttcatgcgtccgccgatgttcgaccgtaaaggtcgtccggcggcggcgtacgaacgtttcgttctgggtcgtcgtcaccgtcgttaccgtttcgacaaagttttcgaagaacgtttcggtcgttctgcgctgttcatctgcccgcgtgttggttgcggtaacttcgaccactcttctgaacagtctgcggttgttctggcgctgatcggttacatcgcggacaaagaaggtatgtctggtaaaaaactggtttacgttcgtctggcggaactgatggcggaatggaaactgaaaaaactggaacgttctcgtgttgaagaacagtcttctgcgcagtaa

SEQ ID NO: 58 - DNA, 3579 bp, Artificial Sequence
  Description of Artificial Sequence: Synthetic polynucleotide
atggcggaatctaaacagatgcagtgccgtaaatgcggtgcgtctatgaaatacgaagttatcggtctgggtaaaaaatcttgccgttacatgtgcccggactgcggtaaccacacctctgcgcgtaaaatccagaacaaaaaaaaacgtgacaaaaaatacggttctgcgtctaaagcgcagtctcagcgtatcgcggttgcgggtgcgctgtacccggacaaaaaagttcagaccatcaaaacctacaaatacccggcggacctgaacggtgaagttcacgactctggtgttgcggaaaaaatcgcgcaggcgatccaggaagacgaaatcggtctgctgggtccgtcttctgaatacgcgtgctggatcgcgtctcagaaacagtctgaaccgtactctgttgttgacttctggttcgacgcggtttgcgcgggtggtgttttcgcgtactctggtgcgcgtctgctgtctaccgttctgcagctgtctggtgaagaatctgttctgcgtgcggcgctggcgtcttctccgttcgttgacgacatcaacctggcgcaggcggaaaaattcctggcggtttctcgtcgtaccggtcaggacaaactgggtaaacgtatcggtgaatgcttcgcggaaggtcgtctggaagcgctgggtatcaaagaccgtatgcgtgaattcgttcaggcgatcgacgttgcgcagaccgcgggtcagcgtttcgcggcgaaactgaaaatcttcggtatctctcagatgccggaagcgaaacagtggaacaacgactctggtctgaccgtttgcatcctgccggactactacgttccggaagaaaaccgtgcggaccagctggttgttctgctgcgtcgtctgcgtgaaatcgcgtactgcatgggtatcgaagacgaagcgggtttcgaacacctgggtatcgacccgggtgcgctgtctaacttctctaacggtaacccgaaacgtggtttcctgggtcgtctgctgaacaacgacatcatcgcgctggcgaacaacatgtctgcgatgaccccgtactgggaaggtcgtaaaggtgaactgatcgaacgtctggcgtggctgaaacaccgtgcggaaggtctgtacctgaaagaaccgcacttcggtaactcttgggcggaccaccgttctcgtatcttctctcgtatcgcgggttggctgtctggttgcgcgggtaaactgaaaatcgcgaaagaccagatctctggtgttcgtaccgacctgttcctgctgaaacgtctgctggacgcggttccgcagtctgcgccgtctccggacttcatcgcgtctatctctgcgctggaccgtttcctggaagcggcggaatcttctcaggacccggcggaacaggttcgtgcgctgtacgcgttccacctgaacgcgccggcggttcgttctatcgcgaacaaagcggttcagcgttctgactctcaggaatggctgatcaaagaactggacgcggttgaccacctggaattcaacaaagcgttcccgttcttctctgacaccggtaaaaaaaaaaaaaaaggtgcgaactctaacggtgcgccgtctgaagaagaatacaccgaaaccgaatctatccagcagccggaagacgcggaacaggaagttaacggtcaggaaggtaacggtgcgtctaaaaaccagaaaaaattccagcgtatcccgcgtttcttcggtgaaggttctcgttctgaataccgtatcctgaccgaagcgccgcagtacttcgacatgttctgcaacaacatgcgtgcgatcttcatgcagctggaatctcagccgcgtaaagcgccgcgtgacttcaaatgcttcctgcagaaccgtctgcagaaactgtacaaacagaccttcctgaacgcgcgttctaacaaatgccgtgcgctgctggaatctgttctgatctcttggggtgaattctacacctacggtgcgaacgaaaaaaaattccgtctgcgtcacgaagcgtctgaacgttcttctgacccggactacgttgttcagcaggcgctggaaatcgcgcgtcgtctgttcctgttcggtttcgaatggcgtgactgctctgcgggtgaacgtgttgacctggttgaaatccacaaaaaagcgatctctttcctgctggcgatcacccaggcggaagtttctgttggttcttacaactggctgggtaactctaccgtttctcgttacctgtctgttgcgggtaccgacaccctgtacggtacccagctggaagaattcctgaacgcgaccgttctgtctcagatgcgtggtctggcgatccgtctgtcttctcaggaactgaaagacggtttcgacgttcagctggaatcttcttgccaggacaacctgcagcacctgctggtttaccgtgcgtctcgtgacctggcggcgtgcaaacgtgcgacctgcccggcggaactggacccgaaaatcctggttctgccggttggtgcgttcatcgcgtctgttatgaaaatgatcgaacgtggtgacgaaccgctggcgggtgcgtacctgcgtcaccgtccgcactctttcggttggcagatccgtgttcgtggtgttgcggaagttggtatggaccagggtaccgcgctggcgttccagaaaccgaccgaatctgaaccgttcaaaatcaaaccgttctctgcgcagtacggtccggttctgtggctgaactcttcttcttactctcagtctcagtacctggacggtttcctgtctcagccgaaaaactggtctatgcgtgttctgccgcaggcgggttctgttcgtgttgaacagcgtgttgcgctgatctggaacctgcaggcgggtaaaatgcgtctggaacgttctggtgcgcgtgcgttcttcatgccggttccgttctctttccgtccgtctggttctggtgacgaagcggttctggcgccgaaccgttacctgggtctgttcccgcactctggtggtatcgaatacgcggttgttgacgttctggactctgcgggtttcaaaatcctggaacgtggtaccatcgcggttaacggtttctctcagaaacgtggtgaacgtcaggaagaagcgcaccgtgaaaaacagcgtcgtggtatctctgacatcggtcgtaaaaaaccggttcaggcggaagttgacgcggcgaacgaactgcaccgtaaatacaccgacgttgcgacccgtctgggttgccgtatcgttgttcagtgggcgccgcagccgaaaccgggtaccgcgccgaccgcgcagaccgtttacgcgcgtgcggttcgtaccgaagcgccgcgttctggtaaccaggaagaccacgcgcgtatgaaatcttcttggggttacacctggggtacctactgggaaaaacgtaaaccggaagacatcctgggtatctctacccaggtttactggaccggtggtatcggtgaatcttgcccggcggttgcggttgcgctgctgggtcacatccgtgcgacctctacccagaccgaatgggaaaaagaagaagttgttttcggtcgtctgaaaaaattcttcccgtcttaa

SEQ ID NO: 59 - DNA, 2958 bp, Artificial Sequence
  Description of Artificial Sequence: Synthetic polynucleotide
atggaaaaacgtatcaacaaaatccgtaaaaaactgtctgcggacaacgcgaccaaaccggtttctcgttctggtccgatgaaaaccctgctggttcgtgttatgaccgacgacctgaaaaaacgtctggaaaaacgtcgtaaaaaaccggaagttatgccgcaggttatctctaacaacgcggcgaacaacctgcgtatgctgctggacgactacaccaaaatgaaagaagcgatcctgcaggtttactggcaggaattcaaagacgaccacgttggtctgatgtgcaaattcgcgcagccggcgtctaaaaaaatcgaccagaacaaactgaaaccggaaatggacgaaaaaggtaacctgaccaccgcgggtttcgcgtgctctcagtgcggtcagccgctgttcgtttacaaactggaacaggtttctgaaaaaggtaaagcgtacaccaactacttcggtcgttgcaacgttgcggaacacgaaaaactgatcctgctggcgcagctgaaaccggaaaaagactctgacgaagcggttacctactctctgggtaaattcggtcagcgtgcgctggacttctactctatccacgttaccaaagaatctacccacccggttaaaccgctggcgcagatcgcgggtaaccgttacgcgtctggtccggttggtaaagcgctgtctgacgcgtgcatgggtaccatcgcgtctttcctgtctaaataccaggacatcatcatcgaacaccagaaagttgttaaaggtaaccagaaacgtctggaatctctgcgtgaactggcgggtaaagaaaacctggaatacccgtctgttaccctgccgccgcagccgcacaccaaagaaggtgttgacgcgtacaacgaagttatcgcgcgtgttcgtatgtgggttaacctgaacctgtggcagaaactgaaactgtctcgtgacgacgcgaaaccgctgctgcgtctgaaaggtttcccgtctttcccggttgttgaacgtcgtgaaaacgaagttgactggtggaacaccatcaacgaagttaaaaaactgatcgacgcgaaacgtgacatgggtcgtgttttctggtctggtgttaccgcggaaaaacgtaacaccatcctggaaggttacaactacctgccgaacgaaaacgaccacaaaaaacgtgaaggttctctggaaaacccgaaaaaaccggcgaaacgtcagttcggtgacctgctgctgtacctggaaaaaaaatacgcgggtgactggggtaaagttttcgacgaagcgtgggaacgtatcgacaaaaaaatcgcgggtctgacctctcacatcgaacgtgaagaagcgcgtaacgcggaagacgcgcagtctaaagcggttctgaccgactggctgcgtgcgaaagcgtctttcgttctggaacgtctgaaagaaatggacgaaaaagaattctacgcgtgcgaaatccagctgcagaaatggtacggtgacctgcgtggtaacccgttcgcggttgaagcggaaaaccgtgttgttgacatctctggtttctctatcggttctgacggtcactctatccagtaccgtaacctgctggcgtggaaatacctggaaaacggtaaacgtgaattctacctgctgatgaactacggtaaaaaaggtcgtatccgtttcaccgacggtaccgacatcaaaaaatctggtaaatggcagggtctgctgtacggtggtggtaaagcgaaagttatcgacctgaccttcgacccggacgacgaacagctgatcatcctgccgctggcgttcggtacccgtcagggtcgtgaattcatctggaacgacctgctgtctctggaaaccggtctgatcaaactggcgaacggtcgtgttatcgaaaaaaccatctacaacaaaaaaatcggtcgtgacgaaccggcgctgttcgttgcgctgaccttcgaacgtcgtgaagttgttgacccgtctaacatcaaaccggttaacctgatcggtgttgaccgtggtgaaaacatcccggcggttatcgcgctgaccgacccggaaggttgcccgctgccggaattcaaagactcttctggtggtccgaccgacatcctgcgtatcggtgaaggttacaaagaaaaacagcgtgcgatccaggcggcgaaagaagttgaacagcgtcgtgcgggtggttactctcgtaaattcgcgtctaaatctcgtaacctggcggacgacatggttcgtaactctgcgcgtgacctgttctaccacgcggttacccacgacgcggttctggttttcgaaaacctgtctcgtggtttcggtcgtcagggtaaacgtaccttcatgaccgaacgtcagtacaccaaaatggaagactggctgaccgcgaaactggcgtacgaaggtctgacctctaaaacctacctgtctaaaaccctggcgcagtacacctctaaaacctgctctaactgcggtttcaccatcaccaccgcggactacgacggtatgctggttcgtctgaaaaaaacctctgacggttgggcgaccaccctgaacaacaaagaactgaaagcggaaggtcagatcacctactacaaccgttacaaacgtcagaccgttgaaaaagaactgtctgcggaactggaccgtctgtctgaagaatctggtaacaacgacatctctaaatggaccaaaggtcgtcgtgacgaagcgctgttcctgctgaaaaaacgtttctctcaccgtccggttcaggaacagttcgtttgcctggactgcggtcacgaagttcacgcggacgaacaggcggcgctgaacatcgcgcgttcttggctgttcctgaactctaactctaccgaattcaaatcttacaaatctggtaaacagccgttcgttggtgcgtggcaggcgttctacaaacgtcgtctgaaagaagtttggaaaccgaacgcg

SEQ ID NO: 60 - DNA, 2919 bp, Artificial Sequence
  Description of Artificial Sequence: Synthetic polynucleotide
atgaaacgtatcaacaaaatccgtcgtcgtctggttaaagactctaacaccaaaaaagcgggtaaaaccggtccgatgaaaaccctgctggttcgtgttatgaccccggacctgcgtgaacgtctggaaaacctgcgtaaaaaaccggaaaacatcccgcagccgatctctaacacctctcgtgcgaacctgaacaaactgctgaccgactacaccgaaatgaaaaaagcgatcctgcacgtttactgggaagaattccagaaagacccggttggtctgatgtctcgtgttgcgcagccggcgccgaaaaacatcgaccagcgtaaactgatcccggttaaagacggtaacgaacgtctgacctcttctggtttcgcgtgctctcagtgctgccagccgctgtacgtttacaaactggaacaggttaacgacaaaggtaaaccgcacaccaactacttcggtcgttgcaacgtttctgaacacgaacgtctgatcctgctgtctccgcacaaaccggaagcgaacgacgaactggttacctactctctgggtaaattcggtcagcgtgcgctggacttctactctatccacgttacccgtgaatctaaccacccggttaaaccgctggaacagatcggtggtaactcttgcgcgtctggtccggttggtaaagcgctgtctgacgcgtgcatgggtgcggttgcgtctttcctgaccaaataccaggacatcatcctggaacaccagaaagttatcaaaaaaaacgaaaaacgtctggcgaacctgaaagacatcgcgtctgcgaacggtctggcgttcccgaaaatcaccctgccgccgcagccgcacaccaaagaaggtatcgaagcgtacaacaacgttgttgcgcagatcgttatctgggttaacctgaacctgtggcagaaactgaaaatcggtcgtgacgaagcgaaaccgctgcagcgtctgaaaggtttcccgtctttcccgctggttgaacgtcaggcgaacgaagttgactggtgggacatggtttgcaacgttaaaaaactgatcaacgaaaaaaaagaagacggtaaagttttctggcagaacctggcgggttacaaacgtcaggaagcgctgctgccgtacctgtcttctgaagaagaccgtaaaaaaggtaaaaaattcgcgcgttaccagttcggtgacctgctgctgcacctggaaaaaaaacacggtgaagactggggtaaagtttacgacgaagcgtgggaacgtatcgacaaaaaagttgaaggtctgtctaaacacatcaaactggaagaagaacgtcgttctgaagacgcgcagtctaaagcggcgctgaccgactggctgcgtgcgaaagcgtctttcgttatcgaaggtctgaaagaagcggacaaagacgaattctgccgttgcgaactgaaactgcagaaatggtacggtgacctgcgtggtaaaccgttcgcgatcgaagcggaaaactctatcctggacatctctggtttctctaaacagtacaactgcgcgttcatctggcagaaagacggtgttaaaaaactgaacctgtacctgatcatcaactacttcaaaggtggtaaactgcgtttcaaaaaaatcaaaccggaagcgttcgaagcgaaccgtttctacaccgttatcaacaaaaaatctggtgaaatcgttccgatggaagttaacttcaacttcgacgacccgaacctgatcatcctgccgctggcgttcggtaaacgtcagggtcgtgaattcatctggaacgacctgctgtctctggaaaccggttctctgaaactggcgaacggtcgtgttatcgaaaaaaccctgtacaaccgtcgtacccgtcaggacgaaccggcgctgttcgttgcgctgaccttcgaacgtcgtgaagttctggactcttctaacatcaaaccgatgaacctgatcggtatcgaccgtggtgaaaacatcccggcggttatcgcgctgaccgacccggaaggttgcccgctgtctcgtttcaaagactctctgggtaacccgacccacatcctgcgtatcggtgaatcttacaaagaaaaacagcgtaccatccaggcggcgaaagaagttgaacagcgtcgtgcgggtggttactctcgtaaatacgcgtctaaagcgaaaaacctggcggacgacatggttcgtaacaccgcgcgtgacctgctgtactacgcggttacccaggacgcgatgctgatcttcgaaaacctgtctcgtggtttcggtcgtcagggtaaacgtaccttcatggcggaacgtcagtacacccgtatggaagactggctgaccgcgaaactggcgtacgaaggtctgccgtctaaaacctacctgtctaaaaccctggcgcagtacacctctaaaacctgctctaactgcggtttcaccatcacctctgcggactacgaccgtgttctggaaaaactgaaaaaaaccgcgaccggttggatgaccaccatcaacggtaaagaactgaaagttgaaggtcagatcacctactacaaccgttacaaacgtcagaacgttgttaaagacctgtctgttgaactggaccgtctgtctgaagaatctgttaacaacgacatctcttcttggaccaaaggtcgttctggtgaagcgctgtctctgctgaaaaaacgtttctctcaccgtccggttcaggaaaaattcgtttgcctgaactgcggtttcgaaacccacgcggacgaacaggcggcgctgaacatcgcgcgttcttggctgttcctgcgttctcaggaatacaaaaaataccagaccaacaaaaccaccggtaacaccgacaaacgtgcgttcgttgaaacctggcagtctttctaccgtaaaaaactgaaagaagtttggaaaccg

SEQ ID NO: 61 - DNA, 4859 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatgggtaaaatgtattaccttggtttagacattggcacgaattccgtgggctacgcggtgaccgacccctcataccacctgctgaagtttaagggggaaccaatgtggggtgcgcacgtatttgccgccggtaatcagagcgcggaacgacgctcgttccgcacatcgcgtcgtcgtttggaccgacgccaacagcgcgttaaactggtacaggagatttttgccccggtgattagtccgatcgacccacgcttcttcattcgtctgcatgaatccgccctgtggcgcgatgacgtcgcggagacggataaacatatctttttcaatgatcctacctataccgataaggaatattatagcgattacccgactatccatcacctgatcgttgatctgatggaaagctctgagaaacacgatccgcggctggtgtaccttgcagtggcgtggttagtggcacaccgtggtcattttctgaacgaggtggacaaggataatattggagatgtgttgtcgttcgacgcattttatccggagtttctcgcgttcctgtcggacaacggtgtatcaccgtgggtgtgcgaaagcaaagcgctgcaggcgaccttgctgagccgtaactcagtgaacgacaaatataaagcccttaagtctctgatcttcggatcccagaaacctgaagataacttcgatgccaatatttcggaagatggactcattcaactgctggccggcaaaaaggtaaaagttaacaaactgttccctcaggaatcgaacgatgcatccttcacattgaatgataaagaagacgcgatagaagaaatcctgggtacgcttacaccagatgaatgtgaatggattgcgcatatacgccgcctttttgactgggctatcatgaaacatgctctgaaagatggcaggactattagcgagtcaaaagtcaaactgtatgagcagcaccatcacgatctgacccaacttaaatacttcgtgaaaacctaccttgcaaaagaatacgacgatattttccgcaacgtggatagcgaaacaacgaaaaactatgtagcgtattcctatcatgtgaaagaggtgaaaggcactctgcctaaaaataaggcaacgcaagaagagttttgtaagtatgtcctgggcaaggttaaaaacattgaatgctctgaagcagacaaggttgactttgatgagatgattcagcgtcttaccgacaactcttttatgcctaagcaggtttcgggcgaaaaccgcgttattccttatcagttatattattatgaactgaagacaattctgaataaagcagcctcgtacctgcctttcctgacgcagtgtggaaaagatgcaatttcgaaccaggacaaactactgtcgatcatgacgttccgtattccttacttcgtcggacccttgcgaaaagataattcggaacatgcatggctcgaacgaaaggccggtaagatttatccgtggaactttaacgacaaagtggacttggataaatcagaagaagcgttcattcgccgaatgaccaatacctgtacctattatcccggcgaagatgttttaccgttggattcgctgatctatgagaaatttatgattttaaatgaaatcaataatattcgtattgacggctacccgattagtgttgacgttaaacagcaggtttttggcttgttcgaaaaaaaacgacgcgtaaccgtgaaagatattcagaacctgctgctgtctctcggagctctggacaaacacgggaagctgacaggcatcgataccactatccactcaaactataatacgtatcaccattttaaatctctcatggaacgcggcgtcctgacccgggatgacgtggaacgcatcgttgaaaggatgacctacagcgacgatactaagcgtgtgcgtctgtggctgaataacaactatggtactttaaccgccgacgatgtgaaacacatttcgcgtctgcgcaaacacgattttggccgtttatccaaaatgttcttaacaggtctgaagggtgtccataaggagaccggtgaacgtgcctccatactggatttcatgtggaacacgaacgataacctgatgcagctcctttccgaatgctacacgttcagtgatgaaatcacaaagctgcaagaggcgtattatgcaaaagcccagttgtctttaaacgattttttagactcgatgtacatctctaacgcggtgaaacgtccgatttacagaactctggcagtggtgaacgatattcgaaaagcatgtgggacggcccctaaacgcattttcatcgaaatggctcgtgatggtgaatcaaaaaaaaagagaagtgttacacgtcgcgagcagatcaaaaacctgtaccgctcgattcgtaaagatttccagcaggaagttgattttctggaaaagatcctggaaaataaatctgatggtcaacttcagtcagatgctttgtatctttactttgcacaattagggcgcgatatgtacacgggcgatccaataaagctggagcacatcaaagatcagagtttctataacatagaccatatttacccgcagtctatggtgaaagacgattccctagataacaaagtgctggtgcaaagcgaaattaacggcgagaaaagctcgcgataccctttggacgccgcgatccgcaataaaatgaagcccctttgggacgcttactataatcatggcctgatctccttaaagaaataccagcgtctaacgcgctcgaccccgtttaccgatgatgaaaaatgggactttattaatcgccagttagtggaaacccgtcaatctaccaaagcgctggccattttgttgaagcgtaagtttccagacaccgaaattgtgtattcgaaggcggggttatcgtccgacttcagacatgaattcggccttgtaaaaagtcgcaatattaatgatttgcaccacgctaaagacgcattcttggctatcgttaccggcaatgtgtaccatgaaagattcaatcgcagatggtttatggtgaaccagccgtactcagttaaaactaaaactctttttacccacagcataaagaatggcaacttcgttgcctggaacggcgaagaagatctcggtcgtattgtaaaaatgctgaagcaaaacaaaaataccattcacttcacgcgcttctccttcgatcgcaaagaaggattatttgatatccaacctctgaaagccagcaccggcttagtcccacgaaaagccggtctggatgtcgttaaatacggcggatatgacaaatctaccgcggcctattacctgctggtgaggttcacgctcgaggacaagaaaacccagcacaagctgatgatgattcctgtagaaggcctgtacaaggctcgcattgatcatgacaaggaatttcttaccgattatgcgcaaacgactataagcgaaatcctacagaaagataaacagaaagtgatcaatattatgtttccaatgggtacgaggcatataaaactcaattcaatgattagtatcgatggcttctatcttagtatcggcggaaagtcctctaaaggtaagtcagttctatgtcacgcaatggttccactgatcgtccctcacaaaatcgaatgttacattaaagcaatggaaagcttcgcccggaagtttaaagaaaacaacaagctgcgcatcgtagaaaaattcgataaaatcaccgttgaagacaacctgaatctctacgagctctttctccaaaaactgcagcataatccctataataagtttttttcgacacagtttgacgtactgacgaacggccgttctactttcacaaaactgtcgccggaggaacaggtacagacgctcttgaacattttaagtatctttaaaacatgccgcagttcgggttgcgacctgaaatccatcaacggcagtgcccaggcagcgcgcatcatgattagcgctgacttaactggactgtcgaaaaaatattcagatattaggttggttgaacagtcagcttctggtttgttcgtatccaaaagtcagaacttactggagtatctctaagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 62 - DNA, 4787 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatgtcatcgctcacgaaattcactaacaaatactctaaacagctcaccattaagaatgaactcatcccagttggcaaaacactggagaacatcaaagagaatggtctgatagatggcgacgaacagctgaatgagaattatcagaaggcgaaaattattgtggatgattttctgcgggacttcattaataaagcactgaataatacgcagatcgggaactggcgcgaactggcggatgcccttaataaagaggatgaagataacatcgagaaattgcaggataaaattcggggaatcattgtatccaaatttgaaacgtttgatctgtttagcagctattctattaagaaagatgaaaagattattgacgacgacaatgatgttgaagaagaggaactggatctgggcaagaagaccagctcatttaaatacatatttaaaaaaaacctgtttaagttagtgttgccatcctacctgaaaaccacaaaccaggacaagctgaagattattagctcgtttgataatttttcaacgtacttccgcgggttctttgaaaaccggaaaaacatttttaccaagaaaccgatctccacaagtattgcgtatcgcattgttcatgataacttcccgaaattccttgataacattcgttgttttaatgtgtggcagacggaatgcccgcaactaatcgtgaaagcagataactatctgaaaagcaaaaatgttatagcgaaagataaaagtttggcaaactattttaccgtgggcgcgtatgactatttcctgtctcagaatggtatagatttttacaacaatattataggtggactgccagcgttcgccggccatgagaaaatccaaggtctcaatgaattcatcaatcaagagtgccaaaaagacagcgagctgaaaagtaagctgaaaaaccgtcacgcgttcaaaatggcggtactgttcaaacagatactcagcgatcgtgaaaaaagttttgtaattgatgagttcgagtcggatgctcaagttattgacgccgttaaaaacttttacgccgaacagtgcaaagataacaatgttatttttaacttattaaatcttatcaagaatatcgctttcttaagtgatgacgaactggacggcatattcattgaagggaaatacctgtcgagcgttagtcaaaaactctatagcgattggtcaaaattacgtaacgacattgaggattcggctaactctaaacaaggcaataaagagctggccaagaagatcaaaaccaacaaaggggatgtagaaaaagcgatctcgaaatatgagttctcgctgtcggaactgaactcgattgtacatgataacaccaagttttctgacctccttagttgtacactgcataaggtggcttctgagaaactggtgaaggtcaatgaaggcgactggccgaaacatctcaagaataatgaagagaaacaaaaaatcaaagagccgcttgatgctctgctggagatctataatacacttctgatttttaactgcaaaagcttcaataaaaacggcaacttctatgtcgactatgatcgttgcatcaatgaactgagttcggtcgtgtatctgtataataaaacacgtaactattgcactaaaaaaccctataacacggacaagttcaaactcaattttaacagtccgcagctcggtgaaggcttttccaagtcgaaagaaaatgactgtctgactcttttgtttaaaaaagacgacaactattatgtaggcattatccgcaaaggtgcaaaaatcaattttgatgatacacaagcaatcgccgataacaccgacaattgcatctttaaaatgaattatttcctacttaaagacgcaaaaaaatttatcccgaaatgtagcattcagctgaaagaagtcaaggcccattttaagaaatctgaagatgattacattttgtctgataaagagaaatttgctagcccgctggtcattaaaaagagcacatttttgctggcaactgcacatgtgaaagggaaaaaaggcaatatcaagaaatttcagaaagaatattcgaaagaaaaccccactgagtatcgcaattctttaaacgaatggattgctttttgtaaagagttcttaaaaacttataaagcggctaccatttttgatataaccacattgaaaaaggcagaggaatatgctgatattgtagaattctacaaggatgtcgataatctgtgctacaaactggagttctgcccgattaaaacctcgtttatagaaaacctgatagataacggcgacctgtatctgtttcgcatcaataacaaagacttcagcagtaaatcgaccggcaccaagaaccttcatacgttatatttacaagctatattcgatgaacgtaatctgaacaatccgacaattatgctgaatgggggagcagaactgttctatcgtaaagaaagtattgagcagaaaaaccgtatcacacacaaagccggttcaattctcgtgaataaggtgtgtaaagacggtacaagcctggatgataagatacgtaatgaaatttatcaatatgagaataaatttattgataccctgtctgatgaagctaaaaaggtgttaccgaatgtcattaaaaaggaagctacccatgacattacaaaagataaacgtttcactagtgacaaattcttctttcactgccccctgacaattaattataaggaaggcgataccaagcagttcaataacgaagtgctgagttttctgcgtggaaatcctgacatcaacattatcggcattgaccgcggagagcgtaatttaatctatgtaacggttataaaccagaaaggcgagattctggattcggtttcattcaataccgtgaccaacaagagttcaaaaatcgagcagacagtcgattatgaagagaaattggcagtccgcgagaaagagaggattgaagcaaaacgttcctgggactctatctcaaaaattgcgacactaaaggaaggttatctgagcgcaatagttcacgagatctgtctgttaatgattaaacacaacgcgatcgttgtcttagagaatcttaatgcaggctttaagcgtattcgtggcggtttatcagaaaaaagtgtttatcaaaaattcgaaaaaatgttgattaacaaactgaactattttgtcagcaagaaggaatccgactggaataaaccgtctggtctgctgaatggactgcagctttcggatcagtttgaaagcttcgaaaaactgggtattcagtctggttttattttttacgtgccggctgcatatacctcaaagattgatccgaccacgggcttcgccaatgttctgaatctgtcgaaggtacgcaatgttgatgcgatcaaaagctttttttctaacttcaacgaaattagttatagcaagaaagaagcccttttcaaattctcattcgatctggattcactgagtaagaaaggctttagtagctttgtgaaatttagtaagagtaaatggaacgtctacacctttggagaacgtatcataaagccaaagaataagcaaggttatcgggaggacaaaagaatcaacttgaccttcgagatgaagaagttacttaacgagtataaggtttcttttgatcttgaaaataacttgattccgaatctcacgagtgccaacctgaaggatactttttggaaagagctattctttatcttcaagactacgctgcagctccgtaacagcgttactaacggtaaagaagatgtgctcatctctccggtcaaaaatgcgaagggtgaattcttcgtttcgggaacgcataacaagactcttccgcaagattgcgatgcgaacggtgcataccatattgcgttgaaaggtctgatgatactcgaacgtaacaaccttgtacgtgaggagaaagatacgaaaaagattatggcgatttcaaacgtggattggttcgagtacgtgcagaaacgtagaggcgttctgtaagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 63 - DNA, 4249 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataacaactacgacgaattcaccaaactgtacccgatccagaaaaccatccgtttcgaactgaaaccgcagggtcgtaccatggaacacctggaaaccttcaacttcttcgaagaagaccgtgaccgtgcggaaaaatacaaaatcctgaaagaagcgatcgacgaataccacaaaaaattcatcgacgaacacctgaccaacatgtctctggactggaactctctgaaacagatctctgaaaaatactacaaatctcgtgaagaaaaagacaaaaaagttttcctgtctgaacagaaacgtatgcgtcaggaaatcgtttctgaattcaaaaaagacgaccgtttcaaagacctgttctctaaaaaactgttctctgaactgctgaaagaagaaatctacaaaaaaggtaaccaccaggaaatcgacgcgctgaaatctttcgacaaattctctggttacttcatcggtctgcacgaaaaccgtaaaaacatgtactctgacggtgacgaaatcaccgcgatctctaaccgtatcgttaacgaaaacttcccgaaattcctggacaacctgcagaaataccaggaagcgcgtaaaaaatacccggaatggatcatcaaagcggaatctgcgctggttgcgcacaacatcaaaatggacgaagttttctctctggaatacttcaacaaagttctgaaccaggaaggtatccagcgttacaacctggcgctgggtggttacgttaccaaatctggtgaaaaaatgatgggtctgaacgacgcgctgaacctggcgcaccagtctgaaaaatcttctaaaggtcgtatccacatgaccccgctgttcaaacagatcctgtctgaaaaagaatctttctcttacatcccggacgttttcaccgaagactctcagctgctgccgtctatcggtggtttcttcgcgcagatcgaaaacgacaaagacggtaacatcttcgaccgtgcgctggaactgatctcttcttacgcggaatacgacaccgaacgtatctacatccgtcaggcggacatcaaccgtgtttctaacgttatcttcggtgaatggggtaccctgggtggtctgatgcgtgaatacaaagcggactctatcaacgacatcaacctggaacgtacctgcaaaaaagttgacaaatggctggactctaaagaattcgcgctgtctgacgttctggaagcgatcaaacgtaccggtaacaacgacgcgttcaacgaatacatctctaaaatgcgtaccgcgcgtgaaaaaatcgacgcggcgcgtaaagaaatgaaattcatctctgaaaaaatctctggtgacgaagaatctatccacatcatcaaaaccctgctggactctgttcagcagttcctgcacttcttcaacctgttcaaagcgcgtcaggacatcccgctggacggtgcgttctacgcggaattcgacgaagttcactctaaactgttcgcgatcgttccgctgtacaacaaagttcgtaactacctgaccaaaaacaacctgaacaccaaaaaaatcaaactgaacttcaaaaacccgaccctggcgaacggttgggaccagaacaaagtttacgactacgcgtctctgatcttcctgcgtgacggtaactactacctgggtatcatcaacccgaaacgtaaaaaaaacatcaaattcgaacagggttctggtaacggtccgttctaccgtaaaatggtttacaaacagatcccgggtccgaacaaaaacctgccgcgtgttttcctgacctctaccaaaggtaaaaaagaatacaaaccgtctaaagaaatcatcgaaggttacgaagcggacaaacacatccgtggtgacaaattcgacctggacttctgccacaaactgatcgacttcttcaaagaatctatcgaaaaacacaaagactggtctaaattcaacttctacttctctccgaccgaatcttacggtgacatctctgaattctacctggacgttgaaaaacagggttaccgtatgcacttcgaaaacatctctgcggaaaccatcgacgaatacgttgaaaaaggtgacctgttcctgttccagatctacaacaaagacttcgttaaagcggcgaccggtaaaaaagacatgcacaccatctactggaacgcggcgttctctccggaaaacctgcaggacgttgttgttaaactgaacggtgaagcggaactgttctaccgtgacaaatctgacatcaaagaaatcgttcaccgtgaaggtgaaatcctggttaaccgtacctacaacggtcgtaccccggttccggacaaaatccacaaaaaactgaccgactaccacaacggtcgtaccaaagacctgggtgaagcgaaagaatacctggacaaagttcgttacttcaaagcgcactacgacatcaccaaagaccgtcgttacctgaacgacaaaatctacttccacgttccgctgaccctgaacttcaaagcgaacggtaaaaaaaacctgaacaaaatggttatcgaaaaattcctgtctgacgaaaaagcgcacatcatcggtatcgaccgtggtgaacgtaacctgctgtactactctatcatcgaccgttctggtaaaatcatcgaccagcagtctctgaacgttatcgacggtttcgactaccgtgaaaaactgaaccagcgtgaaatcgaaatgaaagacgcgcgtcagtcttggaacgcgatcggtaaaatcaaagacctgaaagaaggttacctgtctaaagcggttcacgaaatcaccaaaatggcgatccagtacaacgcgatcgttgttatggaagaactgaactacggtttcaaacgtggtcgtttcaaagttgaaaaacagatctaccagaaattcgaaaacatgctgatcgacaaaatgaactacctggttttcaaagacgcgccggacgaatctccgggtggtgttctgaacgcgtaccagctgaccaacccgctggaatctttcgcgaaactgggtaaacagaccggtatcctgttctacgttccggcggcgtacacctctaaaatcgacccgaccaccggtttcgttaacctgttcaacacctcttctaaaaccaacgcgcaggaacgtaaagaattcctgcagaaattcgaatctatctcttactctgcgaaagacggtggtatcttcgcgttcgcgttcgactaccgtaaattcggtacctctaaaaccgaccacaaaaacgtttggaccgcgtacaccaacggtgaacgtatgcgttacatcaaagaaaaaaaacgtaacgaactgttcgacccgtctaaagaaatcaaagaagcgctgacctcttctggtatcaaatacgacggtggtcagaacatcctgccggacatcctgcgttctaacaacaacggtctgatctacaccatgtactcttctttcatcgcggcgatccagatgcgtgtttacgacggtaaagaagactacatcatctctccgatcaaaaactctaaaggtgaattcttccgtaccgacccgaaacgtcgtgaactgccgatcgacgcggacgcgaacggtgcgtacaacatcgcgctgcgtggtgaactgaccatgcgtgcgatcgcggaaaaattcgacccggactctgaaaaaatggcgaaactggaactgaaacacaaagactggttcgaattcatgcagacccgtggtgactaagaaatcatccttagcgaaagctaaggattttttttatctgaaatgtagggagaccctcaggttaaatattcactcaggaagttattactcaggaagcaaagaggattaca

SEQ ID NO: 64 - DNA, 4679 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatgactaaaacatttgattcagagttttttaatttgtactcgctgcaaaaaacggtacgctttgagttaaaacccgtgggagaaaccgcgtcatttgtggaagactttaaaaacgagggcttgaaacgtgttgtgagcgaagatgaaaggcgagccgtcgattaccagaaagttaaggaaataattgacgattaccatcgggatttcattgaagaaagtttaaattattttccggaacaggtgagtaaagatgctcttgagcaggcgtttcatctttatcagaaactgaaggcagcaaaagttgaggaaagggaaaaagcgctgaaagaatgggaagcgctgcagaaaaagctacgtgaaaaagtggtgaaatgcttctcggactcgaataaagcccgcttctcaaggattgataaaaaggaactgattaaggaagacctgataaattggttggtcgcccagaatcgcgaggatgatatccctacggtcgaaacgtttaacaacttcaccacatattttaccggcttccatgagaatcgtaaaaatatttactccaaagatgatcacgccaccgctattagctttcgccttattcatgaaaatcttccaaagttttttgacaacgtgattagcttcaataagttgaaagagggtttccctgaattaaaatttgataaagtgaaagaggatttagaagtagattatgatctgaagcatgcgtttgaaatagaatatttcgttaacttcgtgacccaagcgggcatagatcagtataattatctgttaggagggaaaaccctggaggacgggacgaaaaaacaagggatgaatgagcaaattaatctgttcaaacaacagcaaacgcgagataaagcgcgtcagattcccaaactgatccccctgttcaaacagattcttagcgaaaggactgaaagccagtcctttattcctaaacaatttgaaagtgatcaggagttgttcgattcactgcagaagttacataataactgccaggataaattcaccgtgctgcaacaagccattctcggtctggcagaggcggatcttaagaaggtcttcatcaaaacctctgatttaaatgccttatctaacaccattttcgggaattacagcgtcttttccgatgcactgaacctgtataaagaaagcctgaaaacgaaaaaagcgcaggaggcttttgagaaactaccggcccattctattcacgacctcattcaatacttggaacagttcaattccagcctggacgcggaaaaacaacagagcaccgacaccgtcctgaactacttcatcaagaccgatgaattatattctcgcttcattaaatccactagcgaggctttcactcaggtgcagcctttgttcgaactggaagccctgtcatctaagcgccgcccaccggaatcggaagatgaaggggcaaaagggcaggaaggcttcgagcagatcaagcgtattaaagcttacctggatacgcttatggaagcggtacactttgcaaagccgttgtatcttgttaagggtcgtaaaatgatcgaagggctcgataaagaccagtccttttatgaagcgtttgaaatggcgtaccaagaacttgaatcgttaatcattcctatctataacaaagcgcggagctatctgtcgcggaaacctttcaaggccgataaattcaagattaattttgacaacaacacgctactgagcggatgggatgcgaacaaggaaactgctaacgcgtccattctgtttaagaaagacgggttatattaccttggaattatgccgaaaggtaagacctttctctttgactactttgtatcgagcgaggattcagagaaactgaaacagcgtcgccagaagaccgccgaagaagctctggcgcaggatggtgaaagttacttcgaaaaaattcgttataaactgttaccaggggcttcaaagatgttaccgaaagtcttttttagcaacaaaaatattggcttttacaacccgtcggatgacattttacgcattcgcaacacagcctctcacaccaaaaacgggacccctcagaaaggccactcaaaagttgagtttaacctgaatgattgtcataagatgattgatttcttcaaatcatcaattcagaaacacccggaatgggggtcttttggctttacgttttctgataccagtgattttgaagacatgagtgccttctaccgggaagtagaaaaccagggttacgtaattagctttgacaaaatcaaagagacctatatacagagccaggtggaacagggtaatctctacttattccagatttataacaaggatttctcgccctacagcaaaggcaaaccaaacctgcatactctgtactggaaagccctgtttgaagaagcgaacctgaataacgtagtggcgaagttgaacggtgaagcggaaatcttcttccgtcgtcactccattaaggcctctgataaagttgtccatccggcaaatcaggccattgataataagaatccacacacggaaaaaacgcagtcaacctttgaatatgacctcgttaaagacaaacgctacacgcaagataagttctttttccacgtcccaatcagcctcaactttaaagcacaaggggtttcaaagtttaatgataaagtcaatgggttcctcaagggcaacccggatgtcaacattataggtatagacaggggcgaacgccatctgctttactttaccgtagtgaatcagaaaggtgaaatactggttcaggaatcattaaataccttgatgtcggacaaagggcacgttaatgattaccagcagaaactggataaaaaagaacaggaacgtgatgctgcgcgtaaatcgtggaccacggttgagaacattaaagagctgaaagaggggtatctaagccatgtggtacacaaactggcgcacctcatcattaaatataacgcaatagtctgcctagaagacttgaattttggctttaaacgcggccgcttcaaagtggaaaaacaagtttatcaaaaatttgaaaaggcgcttatagataaactgaattatctggtttttaaagaaaaggaacttggtgaggtagggcactacttgacagcttatcaactgacggccccgttcgaatcattcaaaaaactgggcaaacagtctggcattctgttttacgtgccggcagattatacttcaaaaatcgatccaacaactggctttgtgaacttcctggacctgagatatcagtctgtagaaaaagctaaacaacttcttagcgattttaatgccattcgttttaacagcgttcagaattactttgaattcgaaattgactataaaaaacttactccgaaacgtaaagtcggaacccaaagtaaatgggtaatttgtacgtatggcgatgtcaggtatcagaaccgtcggaatcaaaaaggtcattgggagaccgaagaagtgaacgtgaccgaaaagctgaaggctctgttcgccagcgattcaaaaactacaactgtgatcgattacgcaaatgatgataacctgatagatgtgattttagagcaggataaagccagcttttttaaagaactgttgtggctcctgaaacttacgatgaccttacgacattccaagatcaaatcggaagatgattttattctgtcaccggtcaagaatgagcagggtgaattctatgatagtaggaaagccggcgaagtgtggccgaaagacgccgacgccaatggcgcctatcatatcgcgctcaaagggctttggaatttgcagcagattaaccagtgggaaaaaggtaaaaccctgaatctggctatcaaaaaccaggattggtttagctttatccaagagaaaccgtatcaggaatgagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 65 - DNA, 4240 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatcatacaggcggtcttcttagtatggacgcgaaagagttcacaggtcagtatccgttgtcgaaaacattacgattcgaacttcggcccatcggccgcacgtgggataacctggaggcctcaggctacttagcggaagaccgccatcgtgccgaatgttatcctcgtgcgaaagagttattggatgacaaccatcgtgccttcctgaatcgtgtgttgccacaaatcgatatggattggcacccgattgcggaggccttttgtaaggtacataaaaaccctggtaataaagaacttgcccaggattacaaccttcagttgtcaaagcgccgtaaggagatcagcgcatatcttcaggatgcagatggctataaaggcctgttcgcgaagcccgccttagacgaagctatgaaaattgcgaaagaaaacgggaacgaaagtgatattgaggttctcgaagcgtttaacggttttagcgtatacttcaccggttatcatgagtcacgcgagaacatttatagcgatgaggatatggtgagcgtagcctaccgaattactgaggataatttcccgcgctttgtctcaaacgctttgatctttgataaattaaacgaaagccatccggatattatctctgaagtatcgggcaatcttggagttgatgacattggtaagtactttgacgtgtcgaactataacaattttctttcccaggccggtatagatgactacaatcacattattggcggccatacaaccgaagacggactgatacaagcgtttaatgtcgtattgaacttacgtcaccaaaaagaccctggctttgaaaaaattcagttcaaacagctctacaaacaaatcctgagcgtgcgtaccagcaaaagctacatcccgaaacagtttgacaactctaaggagatggttgactgcatttgcgattatgtcagcaaaatagagaaatccgaaacagtagaacgggccctgaaactagtccgtaatatcagttctttcgacttgcgcgggatctttgtcaataaaaagaacttgcgcatactgagcaacaaactgataggagattgggacgcgatcgaaaccgcattgatgcatagttcttcatcagaaaacgataagaaaagcgtatatgatagcgcggaggcttttacgttggatgacatcttttcaagcgtgaaaaaattttctgatgcctctgccgaagatattggcaacagggcggaagacatctgtagagtgataagtgagacggccccttttatcaacgatctgcgagcggtggacctggatagcctgaacgacgatggttatgaagcggccgtctcaaaaattcgggagtcgctggagccttatatggatcttttccatgaactggaaattttctcggttggcgatgagttcccaaaatgcgcagcattttacagcgaactggaggaagtcagcgaacagctgatcgaaattattccgttattcaacaaggcgcgttcgttctgcacccggaaacgctatagcaccgataagattaaagtgaacttaaaattcccgaccttggcggacgggtgggacctgaacaaagagagagacaacaaagccgcgattctgcggaaagacggtaagtattatctggcaattctggatatgaagaaagatctgtcaagcattaggaccagcgacgaagatgaatccagcttcgaaaagatggagtataaactgttaccgagtccagtaaaaatgctgccaaagatattcgtaaaatcgaaagccgctaaggaaaaatatggcctgacagatcgtatgcttgaatgctacgataaaggtatgcataagtcgggtagtgcgtttgatcttggcttttgccatgaactcattgattattacaagcgttgtatcgcggagtacccaggctgggatgtgttcgatttcaagtttcgcgaaacttccgattatgggtccatgaaagagttcaatgaagatgtggccggagccggttactatatgagtctgagaaaaattccgtgcagcgaagtgtaccgtctgttagacgagaaatcgatttatctatttcaaatttataacaaagattactctgaaaatgcacatggtaataagaacatgcataccatgtactgggagggtctcttttccccgcaaaacctggagtcgcccgttttcaagttgtcgggtggggcagaacttttctttcgaaaatcctcaatccctaacgatgccaaaacagtacacccgaaaggctcagtgctggttccacgtaatgatgttaacggtcggcgtattccagattcaatctaccgcgaactgacacgctattttaaccgtggcgattgccgaatcagtgacgaagccaaaagttatcttgacaaggttaagactaaaaaagcggaccatgacattgtgaaagatcgccgctttaccgtggataaaatgatgttccacgtcccgattgcgatgaactttaaggcgatcagtaaaccgaacttaaacaaaaaagtcattgatggcatcattgatgatcaggatctgaaaatcattggtattgatcgtggcgagcggaacttaatttacgtcacgatggttgacagaaaagggaatatcttatatcaggattctcttaacatcctcaatggctacgactatcgtaaagctctggatgtgcgcgaatatgacaacaaggaagcgcgtcgtaactggactaaagtggagggcattcgcaaaatgaaggaaggctatctgtcattagcggtctcgaaattagcggatatgattatcgaaaataacgccatcatcgttatggaggacctgaaccacggattcaaagcgggccgctcaaagattgaaaaacaagtttatcagaaatttgagagtatgctgattaacaaactgggctatatggtgttaaaagacaagtcaattgaccaatcaggtggcgcgctgcatggataccagctggcgaaccatgttaccaccttagcatcagttggaaagcagtgtggggttatcttttatataccggcagcgttcactagtaaaatagatccgaccactggtttcgccgatctctttgccctgagtaacgttaaaaacgtagcgagcatgcgtgaattcttttccaaaatgaaatctgtcatttatgataaagctgaaggcaaattcgcattcacctttgattacttggattacaacgtgaagagcgaatgtggtcgtacgctgtggaccgtttacaccgttggtgagcgcttcacctattcccgtgtgaaccgcgaatatgtacgtaaagtccccaccgatattatctatgatgccctccagaaagcaggcattagcgtcgaaggagacttaagggacagaattgccgaaagcgatggcgatacgctgaagtctattttttacgcattcaaatacgcgctagatatgcgcgttgagaatcgcgaggaagactacattcaatcacctgtgaaaaatgcctctggggaatttttttgttcaaaaaatgctggtaaaagcctcccacaagatagcgatgcaaacggtgcatataacattgccctgaaaggtattcttcaattacgcatgctgtctgagcagtacgaccccaacgcggaatctattagacttccgctgataaccaataaagcctggctgacattcatgcagtctggcatgaagacctggaaaaattaggaaatcatccttagcgaaagctaaggattttttttatctgaaatgtagggagaccctcaggttaaatattcactcaggaagttattactcaggaagcaaagaggattaca

SEQ ID NO: 66 - DNA, 4565 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatggatagtttgaaagatttcaccaatctgtaccctgtcagtaagacattgagatttgaattaaagcccgttggaaagactttagaaaatatcgagaaagcaggtattttgaaagaggatgagcatcgtgcagaaagttatcggagggtgaagaaaataattgatacttatcataaggtatttatcgattcttctcttgaaaatatggctaaaatgggtattgagaatgaaataaaagcaatgctccaaagtttctgcgaattgtataaaaaagatcatcgcactgagggtgaagacaaggcattagataaaattcgagcagtacttcgtggcctgattgttggggctttcactggtgtttgcggaagacgggaaaatacagtccaaaacgagaagtacgagagtttgttcaaagaaaagttgataaaagaaattttacctgattttgtgctctctactgaggctgaaagcttgcctttctctgttgaagaagctacgaggtcactgaaggagtttgatagctttacatcctactttgctggtttttacgagaatagaaagaatatatactcgacgaaacctcaatccactgccattgcttatcgtcttattcatgagaacttgccgaagttcattgataatattcttgtttttcagaagatcaaagagcctatagccaaagagctggaacatattcgtgcggacttttctgccggggggtacataaaaaaggatgagagattggaggatattttttcgttgaactattatatccacgtgttatctcaggctgggatcgaaaaatataacgcattgattgggaagattgtgacagaaggagatggagagatgaaagggctcaatgaacacatcaacctttacaaccaacaaagaggcagagaggatcggctccctctttttaggcctctttataaacagatattgagtgacagagagcaattatcatacttgcctgagagttttgaaaaagatgaggagctcctcagggctctaaaagagttctatgatcatatcgcagaagacattctcggacgtactcaacagttgatgacttctatttcagaatatgatttatctcggatatacgtaaggaacgatagccaattgactgatatatcaaaaaaaatgttgggagattggaatgctatctacatggctagagaacgagcatatgaccacgagcaggctcccaaaagaatcacggcgaaatacgagagggacaggattaaagctcttaaaggagaagagagtataagtctggcaaatcttaatagttgtattgcctttctggacaatgttagagattgccgtgtagatacttatctttccacactgggccagaaggaaggaccacatggtctatctaatctcgttgagaacgtttttgcctcataccatgaagcagagcaattgttgagctttccataccccgaagagaataatctgattcaggacaaggacaatgtggtgttaattaagaatcttctcgacaatatcagtgatctgcagaggttcttgaaacctctttggggtatgggagacgaacccgataaagatgaaagattttatggagagtataattatatccgaggagctctagatcaggtgatccctctgtacaataaggtaaggaactacctcactcggaagccttattcgaccagaaaagtaaaactcaattttgggaattctcaattgcttagtggttgggatagaaataaggaaaaggataatagctgtgtgattttgcgtaaggggcagaacttctatttggctattatgaacaataggcacaaaagaagtttcgaaaacaaggtgttgcccgagtataaggagggagaaccttacttcgaaaagatggattataaatttttgcctgatcctaataaaatgcttcctaaggtttttctttcgaaaaaaggaatagagatatacaaaccaagtccgaagcttttagaacaatatggacatggaactcacaaaaagggagatacctttagtatggatgatttgcacgaactgatcgatttcttcaaacactcaatcgaggctcatgaagattggaagcaattcggattcaaattttctgatacggctacttatgagaatgtatctagtttctatagagaagttgaggatcaggggtataagctctctttccgaaaagtttcggaatcttatgtctattcattaatagatcaaggcaagttgtatttatttcagatatacaacaaggacttttctccctgcagcaaagggacacctaatctgcataccttgtattggagaatgctttttgacgagcgcaatttggcagatgtcatatacaaactggatgggaaggctgaaatctttttccgagagaagagtttgaaaaatgatcatcccacgcatccggctggtaagcctatcaaaaagaaaagtcgacaaaaaaaaggagaggagagtctgtttgagtatgatttagtcaaggataggcactatacgatggataagttccagtttcatgtgcctattactatgaattttaaatgttctgcaggaagcaaagtcaatgatatggttaatgctcatattcgagaggcaaaggatatgcatgtcattggaattgatcgtggagaacgcaatctgctgtatatatgcgtgatagatagtcgagggacgattttggatcaaatttctctgaatacgattaacgatatagactatcatgatttattggagagtcgagacaaagaccgtcagcaggagcgccgaaactggcaaactatcgaagggatcaaggagctaaaacaaggctaccttagtcaggcggttcatcggatagccgaactgatggtggcttataaggctgtagttgctttggaggatttgaatatggggttcaaacgtgggcggcagaaagtagaaagttctgtttatcagcagtttgagaaacagctgatagataagctcaactatcttgtggacaagaagaaaaggcctgaagatattggaggattgttgagagcctatcaatttacggccccatttaagagttttaaggaaatgggaaagcaaaacggcttcttgttttatatcccggcttggaacacgagcaacatagatccgactactggatttgttaatttatttcatgcccagtatgaaaatgtagataaagcgaagagcttctttcaaaagtttgattcaattagttacaacccgaagaaagactggtttgagtttgcattcgattataaaaactttactaaaaaggctgaaggaagtcgttctatgtggatattatgcacacatggttcccgaataaagaattttagaaattcccagaagaatggtcaatgggattccgaagaattcgccttgacggaggcttttaagtctctttttgtgcgatatgagatagattataccgctgatttgaaaacagctattgtggacgaaaagcaaaaagacttcttcgtggatcttctgaagctattcaaattgacagtacagatgcgcaacagctggaaagagaaggatttggattatctaatctctcctgtagcaggggctgatggccgtttcttcgatacaagagagggaaataaaagtctgcctaaggatgcagatgccaatggagcttataatattgccctaaaaggactttgggctctacgccagattcggcaaacttcagaaggcggtaaactcaaattggcgatttccaataaggaatggctacagtttgtgcaagagagatcttacgagaaagactgagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 67 - DNA, 4574 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatgaacaacggcacaaataattttcagaacttcatcgggatctcaagtttgcagaaaacgctgcgcaatgctctgatccccacggaaaccacgcaacagttcatcgtcaagaacggaataattaaagaagatgagttacgtggcgagaaccgccagattctgaaagatatcatggatgactactaccgcggattcatctctgagactctgagttctattgatgacatagattggactagcctgttcgaaaaaatggaaattcagctgaaaaatggtgataataaagataccttaattaaggaacagacagagtatcggaaagcaatccataaaaaatttgcgaacgacgatcggtttaagaacatgtttagcgccaaactgattagtgacatattacctgaatttgtcatccacaacaataattattcggcatcagagaaagaggaaaaaacccaggtgataaaattgttttcgcgctttgcgactagctttaaagattacttcaagaaccgtgcaaattgcttttcagcggacgatatttcatcaagcagctgccatcgcatcgtcaacgacaatgcagagatattcttttcaaatgcgctggtctaccgccggatcgtaaaatcgctgagcaatgacgatatcaacaaaatttcgggcgatatgaaagattcattaaaagaaatgagtctggaagaaatatattcttacgagaagtatggggaatttattacccaggaaggcattagcttctataatgatatctgtgggaaagtgaattcttttatgaacctgtattgtcagaaaaataaagaaaacaaaaatttatacaaacttcagaaacttcacaaacagattctatgcattgcggacactagctatgaggtcccgtataaatttgaaagtgacgaggaagtgtaccaatcagttaacggcttccttgataacattagcagcaaacatatagtcgaaagattacgcaaaatcggcgataactataacggctacaacctggataaaatttatatcgtgtccaaattttacgagagcgttagccaaaaaacctaccgcgactgggaaacaattaataccgccctcgaaattcattacaataatatcttgccgggtaacggtaaaagtaaagccgacaaagtaaaaaaagcggttaagaatgatttacagaaatccatcaccgaaataaatgaactagtgtcaaactataagctgtgcagtgacgacaacatcaaagcggagacttatatacatgagattagccatatcttgaataactttgaagcacaggaattgaaatacaatccggaaattcacctagttgaatccgagctcaaagcgagtgagcttaaaaacgtgctggacgtgatcatgaatgcgtttcattggtgttcggtttttatgactgaggaacttgttgataaagacaacaatttttatgcggaactggaggagatttacgatgaaatttatccagtaattagtctgtacaacctggttcgtaactacgttacccagaaaccgtacagcacgaaaaagattaaattgaactttggaataccgacgttagcagacggttggtcaaagtccaaagagtattctaataacgctatcatactgatgcgcgacaatctgtattatctgggcatctttaatgcgaagaataaaccggacaagaagattatcgagggtaatacgtcagaaaataagggtgactacaaaaagatgatttataatttgctcccgggtcccaacaaaatgatcccgaaagttttcttgagcagcaagacgggggtggaaacgtataaaccgagcgcctatatcctagaggggtataaacagaataaacatatcaagtcttcaaaagactttgatatcactttctgtcatgatctgatcgactacttcaaaaactgtattgcaattcatcccgagtggaaaaacttcggttttgattttagcgacaccagtacttatgaagacatttccgggttttatcgtgaggtagagttacaaggttacaagattgattggacatacattagcgaaaaagacattgatctgctgcaggaaaaaggtcaactgtatctgttccagatatataacaaagatttttcgaaaaaatcaaccgggaatgacaaccttcacaccatgtacctgaaaaatcttttctcagaagaaaatcttaaggatatcgtcctgaaacttaacggcgaagcggaaatcttcttcaggaagagcagcataaagaacccaatcattcataaaaaaggctcgattttagtcaaccgtacctacgaagcagaagaaaaagaccagtttggcaacattcaaattgtgcgtaaaaatattccggaaaacatttatcaggagctgtacaaatacttcaacgataaaagcgacaaagagctgtctgatgaagcagccaaactgaagaatgtagtgggacaccacgaggcagcgacgaatatagtcaaggactatcgctacacgtatgataaatacttccttcatatgcctattacgatcaatttcaaagccaataaaacgggttttattaatgataggatcttacagtatatcgctaaagaaaaagacttacatgtgatcggcattgatcggggcgagcgtaacctgatctacgtgtccgtgattgatacttgtggtaatatagttgaacagaaaagctttaacattgtaaacggctacgactatcagataaaactgaaacaacaggagggcgctagacagattgcgcggaaagaatggaaagaaattggtaaaattaaagagatcaaagagggctacctgagcttagtaatccacgagatctctaaaatggtaatcaaatacaatgcaattatagcgatggaggatttgtcttatggttttaaaaaagggcgctttaaggtcgaacggcaagtttaccagaaatttgaaaccatgctcatcaataaactcaactatctggtatttaaagatatttcgattaccgagaatggcggtctcctgaaaggttatcagctgacatacattcctgataaacttaaaaacgtgggtcatcagtgcggctgcattttttatgtgcctgctgcatacacgagcaaaattgatccgaccaccggctttgtgaatatctttaaatttaaagacctgacagtggacgcaaaacgtgaattcattaaaaaatttgactcaattcgttatgacagtgaaaaaaatctgttctgctttacatttgactacaataactttattacgcaaaacacggtcatgagcaaatcatcgtggagtgtgtatacatacggcgtgcgcatcaaacgtcgctttgtgaacggccgcttctcaaacgaaagtgataccattgacataaccaaagatatggagaaaacgttggaaatgacggacattaactggcgcgatggccacgatcttcgtcaagacattatagattatgaaattgttcagcacatattcgaaattttccgtttaacagtgcaaatgcgtaactccttgtctgaactggaggaccgtgattacgatcgtctcatttcacctgtactgaacgaaaataacattttttatgacagcgcgaaagcgggggatgcacttcctaaggatgccgatgcaaatggtgcgtattgtattgcattaaaagggttatatgaaattaaacaaattaccgaaaattggaaagaagatggtaaattttcgcgcgataaactcaaaatcagcaataaagattggttcgactttatccagaataagcgctatctctaagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 68 - DNA, 4489 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataccaataaattcactaaccagtattctctctctaagaccctgcgctttgaactgattccgcaggggaaaaccttggagttcattcaagaaaaaggcctcttgtctcaggataaacagagggctgaatcttaccaagaaatgaagaaaactattgataagtttcataaatatttcattgatttagccttgtctaacgccaaattaactcacttggaaacgtatctggagttatacaacaaatctgccgaaactaagaaagaacagaaatttaaagacgatttgaaaaaagtacaggacaatctgcgtaaagaaattgtcaaatccttcagtgacggcgatgctaaaagcatttttgccattctggacaaaaaagagttgattactgtggaattagaaaagtggtttgaaaacaatgagcagaaagacatctacttcgatgagaaattcaaaactttcaccacctattttacaggatttcatcaaaaccggaagaacatgtactcagtagaaccgaactccacggccattgcgtatcgtttgatccatgagaatctgcctaaatttctggagaatgcgaaagcctttgaaaagattaagcaggtcgaatcgctgcaagtgaattttcgtgaactcatgggcgaatttggtgacgaaggtctaatcttcgttaacgaactggaagaaatgtttcagattaattactacaatgacgtgctatcgcagaacggtatcacaatctacaatagtattatctcagggttcacaaaaaacgatataaaatacaaaggcctgaacgagtatatcaataactacaaccaaacaaaggacaaaaaggataggcttccgaaactgaagcagttatacaaacagattttatctgacagaatctccctgagctttctgccggatgctttcactgatgggaagcaggttctgaaagcgattttcgatttttataagattaacttactgagctacacgattgaaggtcaagaagaatctcaaaacttactgctcttgatccgtcaaaccattgaaaatctatcatcgttcgatacgcagaaaatctacctcaaaaacgatactcacctgactacgatctctcagcaggttttcggggattttagtgtattttcaacagctctgaactactggtatgaaaccaaagtcaatccgaaattcgagacggaatattctaaggccaacgaaaaaaaacgtgagattcttgataaagctaaagccgtatttactaaacaggattacttttctattgctttcctgcaggaagttttatcggagtatatcctgaccctggatcatacatctgatatcgttaaaaaacacagcagcaattgcatcgctgactatttcaaaaaccactttgtcgccaaaaaagaaaacgaaacagacaagactttcgatttcattgctaacatcaccgcaaaataccagtgtattcagggtatcttggaaaacgccgaccaatacgaagacgaactgaaacaagatcagaagctgatcgataatttaaaattcttcttagatgcaatcctggagctgctgcacttcatcaaaccgcttcatttaaagagcgagtccattaccgaaaaggacaccgccttctatgacgtttttgaaaattattatgaagccctctccttgctgactccgctgtataatatggtacgcaattacgtaacccagaaaccatattctaccgaaaaaattaaactgaactttgaaaacgcacagctgctcaacggttgggacgcgaataaagaaggtgactacctcaccaccatcctgaaaaaagatggtaactattttctggcaattatggataagaaacataataaagcattccagaaatttcctgaagggaaagaaaattacgaaaagatggtgtacaaactcttacctggagttaacaaaatgttgccgaaagtattttttagtaataagaacatcgcgtactttaacccgtccaaagaactgctggaaaattataaaaaggagacgcataagaaaggggatacctttaacctggaacattgccataccttaatagacttcttcaaggattccctgaataaacacgaggattggaaatatttcgattttcagtttagtgagaccaagtcataccaggatcttagcggcttttatcgcgaagtagaacaccaaggctataaaattaacttcaaaaacatcgacagcgaatacatcgacggtttagttaacgagggcaaactgtttctgttccagatctattcaaaggattttagcccgttctctaaaggcaaaccaaatatgcatacgttgtactggaaagcactgtttgaagagcaaaacctgcagaatgtgatttataaactgaacggccaagctgagatttttttccgtaaagcctcgattaaaccgaaaaatatcatccttcataagaagaaaataaagatcgctaaaaaacacttcatagataaaaaaaccaaaacctccgaaatagtgcctgttcaaacaattaagaacttgaatatgtactaccagggcaagatatcggaaaaggagttgactcaagacgatcttcgctatatcgataacttttcgatttttaacgaaaaaaacaagacgatcgacatcatcaaagataaacgcttcactgtagataagttccagtttcatgtgccgattactatgaacttcaaagctaccgggggtagctatatcaaccaaacggtgttggaatacctgcagaataacccggaagtcaaaatcattgggctggaccgcggagaacgtcaccttgtgtacttgaccttaatcgatcagcaaggcaacatcttaaaacaagaatcgctgaataccattacggattcaaagattagcaccccgtatcataagctgctcgataacaaggagaatgagcgcgacctggcccgtaaaaactggggcacggtggaaaacattaaggagttaaaggagggttatatttcccaggtagtgcataagatcgccactctcatgctcgaggaaaatgcgatcgttgtcatggaagacttaaacttcggatttaaacgtgggcgatttaaagtagagaaacaaatctaccagaagttagaaaaaatgctgattgacaaattaaattacttggtcctaaaagacaaacagccgcaagaattgggtggattatacaacgccctccaacttaccaataaattcgaaagttttcagaaaatgggtaaacagtcaggctttcttttttatgttcctgcgtggaacacatccaaaatcgaccctacaaccggcttcgtcaattacttctatactaaatatgaaaacgtcgacaaagcaaaagcattctttgaaaagttcgaagcaatacgttttaacgctgagaaaaaatatttcgagttcgaagtcaagaaatactcagactttaaccccaaagctgagggcacacagcaagcgtggacaatctgcacctacggcgagcgcatcgaaacgaagcgtcaaaaagatcagaataacaaatttgtttcaacacctatcaacctgaccgagaagattgaagacttcttaggtaaaaatcagattgtttatggcgacggtaactgtataaaatctcaaatagcctcaaaggatgataaagcatttttcgaaacattattatattggttcaaaatgacactgcagatgcgcaatagtgagacgcgtacagatattgattatcttatcagcccggtcatgaacgacaacggtactttttacaactccagagactatgaaaaacttgagaatccaactctccccaaagatgctgatgcgaacggtgcttatcacatcgcgaaaaaaggtctgatgctgctgaacaaaatcgaccaagccgatctgactaagaaagttgacctaagcatttcaaatcgggactggttacagtttgttcaaaagaacaaatgagaaatcatccttagcgaaagctaaggattttttttatctgaaatgtagggagaccctcaggttaaatattcactcaggaagttattactcaggaagcaaagaggattaca

SEQ ID NO: 69 - DNA, 4805 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatggaacaggaatattatctgggcttggacatgggcaccggttccgtcggctgggctgttactgacagtgaatatcacgttctaagaaagcatggtaaggcattgtggggtgtaagacttttcgaatctgcttccactgctgaagagcgtagaatgtttagaacgagtcgacgtaggctagacaggcgcaattggagaatcgaaattttacaagaaatttttgcggaagagatatctaagaaagacccaggctttttcctgagaatgaaggaatctaagtattaccctgaggataaaagagatataaatggtaactgtcccgaattgccttacgcattatttgtggacgatgattttaccgataaggattaccataaaaagttcccaactatctaccatttacgcaaaatgttaatgaatacagaggaaaccccagacataagactagtttatctggcaatacaccatatgatgaaacatagaggccatttcttactttccggggatatcaacgaaatcaaagagtttggtaccacatttagtaagttactggaaaacataaagaatgaagaattggattggaacttagaactcggaaaagaagaatacgcggttgtcgaatctatcctgaaggataatatgctgaataggtcgaccaaaaaaactaggctgatcaaagcactgaaagccaaatctatctgcgaaaaagctgttttaaatttacttgctggtggcactgttaagttatcagacatttttggtttggaagaattgaacgaaaccgagcgtccaaaaattagtttcgctgataatggctacgatgattacattggtgaggtggaaaacgagttgggcgaacaattttatattatagagacagctaaggcagtctatgactgggctgttttagtagaaatccttggtaaatacacatctatctccgaagcgaaagttgctacttacgaaaagcacaagtccgatctccagtttttgaagaaaattgtcaggaaatatctgactaaggaagaatataaagatattttcgttagtacctctgacaaactgaaaaattactccgcttacatcgggatgaccaagattaatggcaaaaaagttgatctgcaaagcaaaaggtgttcgaaggaagaattttatgatttcattaaaaagaatgtcttaaaaaaattagaaggtcagccagaatacgaatatttgaaagaagaactggaaagagagacattcttaccaaaacaagtcaacagagataatggggtaattccatatcaaattcacctctacgaattaaaaaaaattttaggcaatttacgcgataaaattgaccttatcaaagaaaatgaggataagctggttcaactctttgaattcagaataccctattatgtgggcccactgaacaagattgatgacggcaaagaaggtaaattcacatgggccgtccgcaaatccaatgaaaaaatttacccatggaactttgaaaatgtagtagatattgaagcgtctgcggagaaatttattcgaagaatgactaataaatgcacttacttgatgggagaggatgttctgcctaaagacagcttattatacagcaagtacatggttctaaacgaacttaacaacgttaagttggacggtgagaaattaagtgtagaattgaaacaaagattgtatactgacgtcttctgcaagtacagaaaagtgacagttaaaaaaattaagaattacttgaagtgcgaaggtataatttctggaaacgtagagattactggtattgatggtgatttcaaagcatccctaacagcttaccacgatttcaaggaaatcctgacaggaactgaactcgcaaaaaaagataaagaaaacattattactaatattgttcttttcggtgatgacaagaaattgttgaagaaaagactgaatagactttacccccagattactcccaatcaacttaagaaaatttgtgctttgtcttacacaggatggggtcgtttttcaaaaaagttcttagaagagattaccgcacctgatccagaaacaggcgaagtatggaatataattaccgccttatgggaatcgaacaataatcttatgcaacttctgagcaatgaatatcgtttcatggaagaagttgagacttacaacatgggcaaacagacgaagactttatcctatgaaactgtggaaaatatgtatgtatcaccttctgtcaagagacaaatttggcaaaccttaaaaattgtcaaagaattagaaaaggtaatgaaggagtctcctaaacgtgtgtttattgaaatggctagagaaaaacaagagtcaaaaagaaccgagtcaagaaagaagcagttaatcgatttatataaggcttgtaaaaacgaagagaaagattgggttaaagaattgggggaccaagaggaacaaaaactacggtcggataagttgtatttatactatacgcaaaagggacgatgtatgtattccggcgaggtaatagaattgaaggatttatgggacaatacaaaatatgacatagaccatatatatccccaatcaaaaacgatggacgatagcttgaacaatagagtactcgtgaaaaaaaaatataatgcgaccaaatctgataagtatcctctgaatgaaaatatcagacatgaaagaaaggggttctggaagtccttgttagatggtgggtttataagcaaagaaaagtacgagcgtctaataagaaacacggagttatcgccagaagaactcgctggttttattgagaggcaaatcgtggaaacgagacaatctaccaaagccgttgctgagatcctaaagcaagttttcccagagtcggagattgtctatgtcaaagctggcacagtgagcaggtttaggaaagacttcgaactattaaaggtaagagaagtgaacgatttacatcacgcaaaggacgcttacctaaatatcgttgtaggtaactcatattatgttaaatttaccaagaacgcctcttggtttataaaggagaacccaggtagaacatataacctgaaaaagatgttcacctctggttggaatattgagagaaacggagaagtcgcatgggaagttggtaagaaagggactatagtgacagtaaagcaaattatgaacaaaaataatatcctcgttacaaggcaggttcatgaagcaaagggcggcctttttgaccaacaaattatgaagaaagggaaaggtcaaattgcaataaaagaaaccgatgagagactagcgtcaatagaaaagtatggtggctataataaagctgcgggtgcatactttatgcttgttgaatcaaaagacaagaaaggtaagactattagaactatagaatttatacccctgtaccttaaaaacaaaattgaatcggatgagtcaatcgcgttaaattttctagagaaaggaaggggtttaaaagaaccaaagatcctgttaaaaaagattaagattgacaccttgttcgatgtagatggatttaaaatgtggttatctggcagaacaggcgatagacttttgtttaagtgcgctaatcaattaattttggatgagaaaatcattgtcacaatgaaaaaaatagttaagtttattcagagaagacaagaaaacagggagttgaaattatctgataaagatggtatcgacaatgaagttttaatggaaatctacaatacattcgttgataaacttgaaaataccgtatatcgaatcaggttaagtgaacaagccaaaacattaattgataaacaaaaagaatttgaaaggctatcactggaagacaaatcctccaccctatttgaaattttgcatatattccagtgccaatcttcagcagctaatttaaaaatgattggcggacctgggaaagccggcatcctagtgatgaacaataatatctccaagtgtaacaaaatatcaattattaaccaatctccgacaggtatttttgaaaatgaaatagacttgcttaagatataagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 70 - DNA, 4363 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccattctttcgactctttcaccaacctgtactctctgtctaaaaccctgaaattcgaaatgcgtccggttggtaacacccagaaaatgctggacaacgcgggtgttttcgaaaaagacaaactgatccagaaaaaatacggtaaaaccaaaccgtacttcgaccgtctgcaccgtgaattcatcgaagaagcgctgaccggtgttgaactgatcggtctggacgaaaacttccgtaccctggttgactggcagaaagacaaaaaaaacaacgttgcgatgaaagcgtacgaaaactctctgcagcgtctgcgtaccgaaatcggtaaaatcttcaacctgaaagcggaagactgggttaaaaacaaatacccgatcctgggtctgaaaaacaaaaacaccgacatcctgttcgaagaagcggttttcggtatcctgaaagcgcgttacggtgaagaaaaagacaccttcatcgaagttgaagaaatcgacaaaaccggtaaatctaaaatcaaccagatctctatcttcgactcttggaaaggtttcaccggttacttcaaaaaattcttcgaaacccgtaaaaacttctacaaaaacgacggtacctctaccgcgatcgcgacccgtatcatcgaccagaacctgaaacgtttcatcgacaacctgtctatcgttgaatctgttcgtcagaaagttgacctggcggaaaccgaaaaatctttctctatctctctgtctcagttcttctctatcgacttctacaacaaatgcctgctgcaggacggtatcgactactacaacaaaatcatcggtggtgaaaccctgaaaaacggtgaaaaactgatcggtctgaacgaactgatcaaccagtaccgtcagaacaacaaagaccagaaaatcccgttcttcaaactgctggacaaacagatcctgtctgaaaaaatcctgttcctggacgaaatcaaaaacgacaccgaactgatcgaagcgctgtctcagttcgcgaaaaccgcggaagaaaaaaccaaaatcgttaaaaaactgttcgcggacttcgttgaaaacaactctaaatacgacctggcgcagatctacatctctcaggaagcgttcaacaccatctctaacaaatggacctctgaaaccgaaaccttcgcgaaatacctgttcgaagcgatgaaatctggtaaactggcgaaatacgaaaaaaaagacaactcttacaaattcccggacttcatcgcgctgtctcagatgaaatctgcgctgctgtctatctctctggaaggtcacttctggaaagaaaaatactacaaaatctctaaattccaggaaaaaaccaactgggaacagttcctggcgatcttcctgtacgaattcaactctctgttctctgacaaaatcaacaccaaagacggtgaaaccaaacaggttggttactacctgttcgcgaaagacctgcacaacctgatcctgtctgaacagatcgacatcccgaaagactctaaagttaccatcaaagacttcgcggactctgttctgaccatctaccagatggcgaaatacttcgcggttgaaaaaaaacgtgcgtggctggcggaatacgaactggactctttctacacccagccggacaccggttacctgcagttctacgacaacgcgtacgaagacatcgttcaggtttacaacaaactgcgtaactacctgaccaaaaaaccgtactctgaagaaaaatggaaactgaacttcgaaaactctaccctggcgaacggttgggacaaaaacaaagaatctgacaactctgcggttatcctgcagaaaggtggtaaatactacctgggtctgatcaccaaaggtcacaacaaaatcttcgacgaccgtttccaggaaaaattcatcgttggtatcgaaggtggtaaatacgaaaaaatcgtttacaaattcttcccggaccaggcgaaaatgttcccgaaagtttgcttctctgcgaaaggtctggaattcttccgtccgtctgaagaaatcctgcgtatctacaacaacgcggaattcaaaaaaggtgaaacctactctatcgactctatgcagaaactgatcgacttctacaaagactgcctgaccaaatacgaaggttgggcgtgctacaccttccgtcacctgaaaccgaccgaagaataccagaacaacatcggtgaattcttccgtgacgttgcggaagacggttaccgtatcgacttccagggtatctctgaccagtacatccacgaaaaaaacgaaaaaggtgaactgcacctgttcgaaatccacaacaaagactggaacctggacaaagcgcgtgacggtaaatctaaaaccacccagaaaaacctgcacaccctgtacttcgaatctctgttctctaacgacaacgttgttcagaacttcccgatcaaactgaacggtcaggcggaaatcttctaccgtccgaaaaccgaaaaagacaaactggaatctaaaaaagacaaaaaaggtaacaaagttatcgaccacaaacgttactctgaaaacaaaatcttcttccacgttccgctgaccctgaaccgtaccaaaaacgactcttaccgtttcaacgcgcagatcaacaacttcctggcgaacaacaaagacatcaacatcatcggtgttgaccgtggtgaaaaacacctggtttactactctgttatcacccaggcgtctgacatcctggaatctggttctctgaacgaactgaacggtgttaactacgcggaaaaactgggtaaaaaagcggaaaaccgtgaacaggcgcgtcgtgactggcaggacgttcagggtatcaaagacctgaaaaaaggttacatctctcaggttgttcgtaaactggcggacctggcgatcaaacacaacgcgatcatcatcctggaagacctgaacatgcgtttcaaacaggttcgtggtggtatcgaaaaatctatctaccagcagctggaaaaagcgctgatcgacaaactgtctttcctggttgacaaaggtgaaaaaaacccggaacaggcgggtcacctgctgaaagcgtaccagctgtctgcgccgttcgaaaccttccagaaaatgggtaaacagaccggtatcatcttctacacccaggcgtcttacacctctaaatctgacccggttaccggttggcgtccgcacctgtacctgaaatacttctctgcgaaaaaagcgaaagacgacatcgcgaaattcaccaaaatcgaattcgttaacgaccgtttcgaactgacctacgacatcaaagacttccagcaggcgaaagaatacccgaacaaaaccgtttggaaagtttgctctaacgttgaacgtttccgttgggacaaaaacctgaaccagaacaaaggtggttacacccactacaccaacatcaccgaaaacatccaggaactgttcaccaaatacggtatcgacatcaccaaagacctgctgacccagatctctaccatcgacgaaaaacagaacacctctttcttccgtgacttcatcttctacttcaacctgatctgccagatccgtaacaccgacgactctgaaatcgcgaaaaaaaacggtaaagacgacttcatcctgtctccggttgaaccgttcttcgactctcgtaaagacaacggtaacaaactgccggaaaacggtgacgacaacggtgcgtacaacatcgcgcgtaaaggtatcgttatcctgaacaaaatctctcagtactctgaaaaaaacgaaaactgcgaaaaaatgaaatggggtgacctgtacgtttctaacatcgactgggacaacttcgttgaaatcatccttagcgaaagctaaggattttttttatctgaaatgtagggagaccctcaggttaaatattcactcaggaagttattactcaggaagcaaagaggattaca

SEQ ID NO: 71 - DNA, 4375 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataacaaattcgaaaacttcaccggtctgtacccgatctctaaaaccctgcgtttcgaactgatcccgcagggtaaaaccctggaatacatcgaaaaatctgaaatcctggaaaacgacaactaccgtgcggaaaaatacgaagaagttaaagacatcatcgacggttaccacaaatggttcatcaacgaaaccctgcacgacctgcacatcaactggtctgaactgaaagttgcgctggaaaacaaccgtatcgaaaaatctgacgcgtctaaaaaagaactgcagcgtgttcagaaaatcaaacgtgaagaaatctacaacgcgttcatcgaacacgaagcgttccagtacctgttcaaagaaaacctgctgtctgacctgctgccgatccagatcgaacagtctgaagacctggacgcggaaaaaaaaaaacaggcggttgaaaccttcaaccgtttctctacctacttcaccggtttccacgaaaaccgtaaaaacatctactctaaagaaggtatctctacctctgttacctaccgtatcgttcacgacaacttcccgaaattcctggaaaacatgaaagttttcgaaatcctgcgtaacgaatgcccggaagttatctctgacaccgcgaacgaactggcgccgttcatcgacggtgttcgtatcgaagacatcttcctgatcgacttcttcaactctaccttctctcagaacggtatcgactactacaaccgtatcctgggtggtgttaccaccgaaaccggtgaaaaataccgtggtatcaacgaattcaccaacctgtaccgtcagcagcacccggaattcggtaaatctaaaaaagcgaccaaaatggttgttctgttcaaacagatcctgtctgaccgtgacaccctgtctttcatcccggaaatgttcggtaacgacaaacaggttcagaactctatccagctgttctacaaccgtgaaatctctcagttcgaaaacgaaggtgttaaaaccgacgtttgcaccgcgctggcgaccctgacctctaaaatcgcggaattcgacaccgaaaaaatctacatccagcagccggaactgccgaacgtttctcagcgtctgttcggttcttggaacgaactgaacgcgtgcctgttcaaatacgcggaactgaaattcggtaccgcggaaaaagttgcgaaccgtaaaaaaatcgacaaatggctgaaatctgacctgttctctttcaccgaactgaacaaagcgctggaattctctggtaaagacgaacgtatcgaaaactacttctctgaaaccggtatcttcgcgcagctggttaaaaccggtttcgacgaagcgcagtctatcctggaaaccgaatacacctctgaagttcacctgaaagaccagcagaccgacatcgaaaaaatcaaaaccttcctggacgcgctgcagaacctgatgcacctgctgaaatctctgtgcgtttctgaagaagcggaccgtgacgcggcgttctacaacgaattcgacatgctgtacaaccagctgaaactggttgttccgctgtacaacaaagttcgtaactacatcacccagaaactgttccgttctgacaaaatcaaaatctacttcgaaaacaaaggtcagttcctgggtggttgggttgactctcagaccgaaaactctgacaacggtacccaggcgggtggttacatcttccgtaaagaaaacgttatcaacgaatacgactactacctgggtatctgctctgacccgaaactgttccgtcgtaccaccatcgtttctgaaaacgaccgttcttctttcgaacgtctggactactaccagctgaaaaccgcgtctgtttacggtaactcttactgcggtaaacacccgtacaccgaagacaaaaacgaactggttaactctatcgaccgtttcgttcacctgtctggtaacaacatcctgatcgaaaaaatcgcgaaagacaaagttaaatctaacccgaccaccaacaccccgtctggttacctgaacttcatccaccgtgaagcgccgaacacctacgaatgcctgctgcaggacgaaaacttcgtttctctgaaccagcgtgttgtttctgcgctgaaagcgaccctggcgaccctggttcgtgttccgaaagcgctggtttacgcgaaaaaagactaccacctgttctctgaaatcatcaacgacatcgacgaactgtcttacgaaaaagcgttctcttacttcccggtttctcagaccgaattcgaaaactcttctaaccgtaccatcaaaccgctgctgctgttcaaaatctctaacaaagacctgtctttcgcggaaaacttcgaaaaaggtaaccgtcagaaaatcggtaaaaaaaacctgcacaccctgtacttcgaagcgctgatgaaaggtaaccaggacaccatcgacatcggtaccggtatggttttccaccgtgttaaatctctgaactacaacgaaaaaaccctgaaatacggtcaccactctacccagctgaacgaaaaattctcttacccgatcatcaaagacaaacgtttcgcgtctgacaaattcctgttccacctgtctaccgaaatcaactacaaagaaaaacgtaaaccgctgaacaactctatcatcgaattcctgaccaacaacccggacatcaacatcatcggtctggaccgtggtgaacgtcacctgatctacctgaccctgatcaaccagaaaggtgaaatcctgcgtcagaaaaccttcaacatcgttggtaacaccaactaccacgaaaaactgaaccagcgtgaaaaagaacgtgacaacgcgcgtaaatcttgggcgaccatcggtaaaatcaaagaactgaaagaaggtttcctgtctctggttatccacgaaatcgcgaaaatcatggttgaaaacaacgcgatcgttgttctggaagacctgaacttcggtttcaaacgtggtcgtttcaaagttgaaaaacagatctaccagaaattcgaaaaaatgctgatcgacaaactgaactacctggttttcaaagacaaaaaagcgaacgaagcgggtggtgttctgaaaggttaccagctggcggaaaaattcgaatctttccagaaaatgggtaaacagtctggtttcctgttctacgttccggcggcgtacacctctaaaatcgacccgaccaccggtttcgttaacatgctgaacctgaactacaccaacatgaaagacgcgcagaccctgctgtctggtatggacaaaatctctttcaacgcggacgcgaactacttcgaattcgaactggactacgaaaaattcaaaaccaaccagaccgaccacaccaacaaatggaccatctgcaccgttggtgaaaaacgtttcacctacaactctgcgaccaaagaaaccaccaccgttaacgttaccgaagacctgaaaaaactgctggacaaattcgaagttaaatactctaacggtgacaacatcaaagacgaaatctgccgtcagaccgacgcgaaattcttcgaaatcatcctgtggctgctgaaactgaccatgcagatgcgtaactctaacaccaaaaccgaagaagacttcatcctgtctccggttaaaaactctaacggtgaattcttccgttctaacgacgacgcgaacggtatctggccggcggacgcggacgcgaacggtgcgtaccacatcgcgctgaaaggtctgtacctggttaaagaatgcttcaacaaaaacgaaaaatctctgaaaatcgaacacaaaaactggttcaaattcgcgcagacccgtttcaacggttctctgaccaaaaacggttaagaaatcatccttagcgaaagctaaggattttttttatctgaaatgtagggagaccctcaggttaaatattcactcaggaagttattactcaggaagcaaagaggattaca

SEQ ID NO: 72 - DNA, 4455 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatacccagttcgaaggtttcaccaacctgtaccaggtttctaaaaccctgcgtttcgaactgatcccgcagggtaaaaccctgaaacacatccaggaacagggtttcatcgaagaagacaaagcgcgtaacgaccactacaaagaactgaaaccgatcatcgaccgtatctacaaaacctacgcggaccagtgcctgcagctggttcagctggactgggaaaacctgtctgcggcgatcgactcttaccgtaaagaaaaaaccgaagaaacccgtaacgcgctgatcgaagaacaggcgacctaccgtaacgcgatccacgactacttcatcggtcgtaccgacaacctgaccgacgcgatcaacaaacgtcacgcggaaatctacaaaggtctgttcaaagcggaactgttcaacggtaaagttctgaaacagctgggtaccgttaccaccaccgaacacgaaaacgcgctgctgcgttctttcgacaaattcaccacctacttctctggtttctacgaaaaccgtaaaaacgttttctctgcggaagacatctctaccgcgatcccgcaccgtatcgttcaggacaacttcccgaaattcaaagaaaactgccacatcttcacccgtctgatcaccgcggttccgtctctgcgtgaacacttcgaaaacgttaaaaaagcgatcggtatcttcgtttctacctctatcgaagaagttttctctttcccgttctacaaccagctgctgacccagacccagatcgacctgtacaaccagctgctgggtggtatctctcgtgaagcgggtaccgaaaaaatcaaaggtctgaacgaagttctgaacctggcgatccagaaaaacgacgaaaccgcgcacatcatcgcgtctctgccgcaccgtttcatcccgctgttcaaacagatcctgtctgaccgtaacaccctgtctttcatcctggaagaattcaaatctgacgaagaagttatccagtctttctgcaaatacaaaaccctgctgcgtaacgaaaacgttctggaaaccgcggaagcgctgttcaacgaactgaactctatcgacctgacccacatcttcatctctcacaaaaaactggaaaccatctcttctgcgctgtgcgaccactgggacaccctgcgtaacgcgctgtacgaacgtcgtatctctgaactgaccggtaaaatcaccaaatctgcgaaagaaaaagttcagcgttctctgaaacacgaagacatcaacctgcaggaaatcatctctgcggcgggtaaagaactgtctgaagcgttcaaacagaaaacctctgaaatcctgtctcacgcgcacgcggcgctggaccagccgctgccgaccaccctgaaaaaacaggaagaaaaagaaatcctgaaatctcagctggactctctgctgggtctgtaccacctgctggactggttcgcggttgacgaatctaacgaagttgacccggaattctctgcgcgtctgaccggtatcaaactggaaatggaaccgtctctgtctttctacaacaaagcgcgtaactacgcgaccaaaaaaccgtactctgttgaaaaattcaaactgaacttccagatgccgaccctggcgtctggttgggacgttaacaaagaaaaaaacaacggtgcgatcctgttcgttaaaaacggtctgtactacctgggtatcatgccgaaacagaaaggtcgttacaaagcgctgtctttcgaaccgaccgaaaaaacctctgaaggtttcgacaaaatgtactacgactacttcccggacgcggcgaaaatgatcccgaaatgctctacccagctgaaagcggttaccgcgcacttccagacccacaccaccccgatcctgctgtctaacaacttcatcgaaccgctggaaatcaccaaagaaatctacgacctgaacaacccggaaaaagaaccgaaaaaattccagaccgcgtacgcgaaaaaaaccggtgaccagaaaggttaccgtgaagcgctgtgcaaatggatcgacttcacccgtgacttcctgtctaaatacaccaaaaccacctctatcgacctgtcttctctgcgtccgtcttctcagtacaaagacctgggtgaatactacgcggaactgaacccgctgctgtaccacatctctttccagcgtatcgcggaaaaagaaatcatggacgcggttgaaaccggtaaactgtacctgttccagatctacaacaaagacttcgcgaaaggtcaccacggtaaaccgaacctgcacaccctgtactggaccggtctgttctctccggaaaacctggcgaaaacctctatcaaactgaacggtcaggcggaactgttctaccgtccgaaatctcgtatgaaacgtatggcgcaccgtctgggtgaaaaaatgctgaacaaaaaactgaaagaccagaaaaccccgatcccggacaccctgtaccaggaactgtacgactacgttaaccaccgtctgtctcacgacctgtctgacgaagcgcgtgcgctgctgccgaacgttatcaccaaagaagtttctcacgaaatcatcaaagaccgtcgtttcacctctgacaaattcttcttccacgttccgatcaccctgaactaccaggcggcgaactctccgtctaaattcaaccagcgtgttaacgcgtacctgaaagaacacccggaaaccccgatcatcggtatcgaccgtggtgaacgtaacctgatctacatcaccgttatcgactctaccggtaaaatcctggaacagcgttctctgaacaccatccagcagttcgactaccagaaaaaactggacaaccgtgaaaaagaacgtgttgcggcgcgtcaggcgtggtctgttgttggtaccatcaaagacctgaaacagggttacctgtctcaggttatccacgaaatcgttgacctgatgatccactaccaggcggttgttgttctggaaaacctgaacttcggtttcaaatctaaacgtaccggtatcgcggaaaaagcggtttaccagcagttcgaaaaaatgctgatcgacaaactgaactgcctggttctgaaagactacccggcggaaaaagttggtggtgttctgaacccgtaccagctgaccgaccagttcacctctttcgcgaaaatgggtacccagtctggtttcctgttctacgttccggcgccgtacacctctaaaatcgacccgctgaccggtttcgttgacccgttcgtttggaaaaccatcaaaaaccacgaatctcgtaaacacttcctggaaggtttcgacttcctgcactacgacgttaaaaccggtgacttcatcctgcacttcaaaatgaaccgtaacctgtctttccagcgtggtctgccgggtttcatgccggcgtgggacatcgttttcgaaaaaaacgaaacccagttcgacgcgaaaggtaccccgttcatcgcgggtaaacgtatcgttccggttatcgaaaaccaccgtttcaccggtcgttaccgtgacctgtacccggcgaacgaactgatcgcgctgctggaagaaaaaggtatcgttttccgtgacggttctaacatcctgccgaaactgctggaaaacgacgactctcacgcgatcgacaccatggttgcgctgatccgttctgttctgcagatgcgtaactctaacgcggcgaccggtgaagactacatcaactctccggttcgtgacctgaacggtgtttgcttcgactctcgtttccagaacccggaatggccgatggacgcggacgcgaacggtgcgtaccacatcgcgctgaaaggtcagctgctgctgaaccacctgaaagaatctaaagacctgaaactgcagaacggtatctctaaccaggactggctggcgtacatccaggaactgcgtaactagaaatcatccttagcgaaagctaaggattttttttatctgaaatgtagggagaccctcaggttaaatattcactcaggaagttattactcaggaagcaaagaggattaca

SEQ ID NO: 73 - DNA, 3922 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatgcggttaaatctatcaaagttaaactgcgtctggacgacatgccggaaatccgtgcgggtctgtggaaactgcacaaagaagttaacgcgggtgttcgttactacaccgaatggctgtctctgctgcgtcaggaaaacctgtaccgtcgttctccgaacggtgacggtgaacaggaatgcgacaaaaccgcggaagaatgcaaagcggaactgctggaacgtctgcgtgcgcgtcaggttgaaaacggtcaccgtggtccggcgggttctgacgacgaactgctgcagctggcgcgtcagctgtacgaactgctggttccgcaggcgatcggtgcgaaaggtgacgcgcagcagatcgcgcgtaaattcctgtctccgctggcggacaaagacgcggttggtggtctgggtatcgcgaaagcgggtaacaaaccgcgttgggttcgtatgcgtgaagcgggtgaaccgggttgggaagaagaaaaagaaaaagcggaaacccgtaaatctgcggaccgtaccgcggacgttctgcgtgcgctggcggacttcggtctgaaaccgctgatgcgtgtttacaccgactctgaaatgtcttctgttgaatggaaaccgctgcgtaaaggtcaggcggttcgtacctgggaccgtgacatgttccagcaggcgatcgaacgtatgatgtcttgggaatcttggaaccagcgtgttggtcaggaatacgcgaaactggttgaacagaaaaaccgtttcgaacagaaaaacttcgttggtcaggaacacctggttcacctggttaaccagctgcagcaggacatgaaagaagcgtctccgggtctggaatctaaagaacagaccgcgcactacgttaccggtcgtgcgctgcgtggttctgacaaagttttcgaaaaatggggtaaactggcgccggacgcgccgttcgacctgtacgacgcggaaatcaaaaacgttcagcgtcgtaacacccgtcgtttcggttctcacgacctgttcgcgaaactggcggaaccggaataccaggcgctgtggcgtgaagacgcgtctttcctgacccgttacgcggtttacaactctatcctgcgtaaactgaaccacgcgaaaatgttcgcgaccttcaccctgccggacgcgaccgcgcacccgatctggacccgtttcgacaaactgggtggtaacctgcaccagtacaccttcctgttcaacgaattcggtgaacgtcgtcacgcgatccgtttccacaaactgctgaaagttgaaaacggtgttgcgcgtgaagttgacgacgttaccgttccgatctctatgtctgaacagctggacaacctgctgccgcgtgacccgaacgaaccgatcgcgctgtacttccgtgactacggtgcggaacagcacttcaccggtgaattcggtggtgcgaaaatccagtgccgtcgtgaccagctggcgcacatgcaccgtcgtcgtggtgcgcgtgacgtttacctgaacgtttctgttcgtgttcagtctcagtctgaagcgcgtggtgaacgtcgtccgccgtacgcggcggttttccgtctggttggtgacaaccaccgtgcgttcgttcacttcgacaaactgtctgactacctggcggaacacccggacgacggtaaactgggttctgaaggtctgctgtctggtctgcgtgttatgtctgttgacctgggtctgcgtacctctgcgtctatctctgttttccgtgttgcgcgtaaagacgaactgaaaccgaactctaaaggtcgtgttccgttcttcttcccgatcaaaggtaacgacaacctggttgcggttcacgaacgttctcagctgctgaaactgccgggtgaaaccgaatctaaagacctgcgtgcgatccgtgaagaacgtcagcgtaccctgcgtcagctgcgtacccagctggcgtacctgcgtctgctggttcgttgcggttctgaagacgttggtcgtcgtgaacgttcttgggcgaaactgatcgaacagccggttgacgcggcgaaccacatgaccccggactggcgtgaagcgttcgaaaacgaactgcagaaactgaaatctctgcacggtatctgctctgacaaagaatggatggacgcggtttacgaatctgttcgtcgtgtttggcgtcacatgggtaaacaggttcgtgactggcgtaaagacgttcgttctggtgaacgtccgaaaatccgtggttacgcgaaagacgttgttggtggtaactctatcgaacagatcgaatacctggaacgtcagtacaaattcctgaaatcttggtctttcttcggtaaagtttctggtcaggttatccgtgcggaaaaaggttctcgtttcgcgatcaccctgcgtgaacacatcgaccacgcgaaagaagaccgtctgaaaaaactggcggaccgtatcatcatggaagcgctgggttacgtttacgcgctggacgaacgtggtaaaggtaaatgggttgcgaaatacccgccgtgccagctgatcctgctggaagaactgtctgaataccagttcaacaacgaccgtccgccgtctgaaaacaaccagctgatgcagtggtctcaccgtggtgttttccaggaactgatcaaccaggcgcaggttcacgacctgctggttggtaccatgtacgcggcgttctcttctcgtttcgacgcgcgtaccggtgcgccgggtatccgttgccgtcgtgttccggcgcgttgcacccaggaacacaacccggaaccgttcccgtggtggctgaacaaattcgttgttgaacacaccctggacgcgtgcccgctgcgtgcggacgacctgatcccgaccggtgaaggtgaaatcttcgtttctccgttctctgcggaagaaggtgacttccaccagatccacgcggacctgaacgcggcgcagaacctgcagcagcgtctgtggtctgacttcgacatctctcagatccgtctgcgttgcgactggggtgaagttgacggtgaactggttctgatcccgcgtctgaccggtaaacgtaccgcggactcttactctaacaaagttttctacaccaacaccggtgttacctactacgaacgtgaacgtggtaaaaaacgtcgtaaagttttcgcgcaggaaaaactgtctgaagaagaagcggaactgctggttgaagcggacgaagcgcgtgaaaaatctgttgttctgatgcgtgacccgtctggtatcatcaaccgtggtaactggacccgtcagaaagaattctggtctatggttaaccagcgtatcgaaggttacctggttaaacagatccgttctcgtgttccgctgcaggactctgcgtgcgaaaacaccggtgacatctaagaaatcatccttagcgaaagctaaggattttttttatctgaaatgtagggagaccctcaggttaaatattcactcaggaagttattactcaggaagcaaagaggattaca

SEQ ID NO: 74 - DNA, 3859 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatgcgacccgttctttcatcctgaaaatcgaaccgaacgaagaagttaaaaaaggtctgtggaaaacccacgaagttctgaaccacggtatcgcgtactacatgaacatcctgaaactgatccgtcaggaagcgatctacgaacaccacgaacaggacccgaaaaacccgaaaaaagtttctaaagcggaaatccaggcggaactgtgggacttcgttctgaaaatgcagaaatgcaactctttcacccacgaagttgacaaagacgttgttttcaacatcctgcgtgaactgtacgaagaactggttccgtcttctgttgaaaaaaaaggtgaagcgaaccagctgtctaacaaattcctgtacccgctggttgacccgaactctcagtctggtaaaggtaccgcgtcttctggtcgtaaaccgcgttggtacaacctgaaaatcgcgggtgacccgtcttgggaagaagaaaaaaaaaaatgggaagaagacaaaaaaaaagacccgctggcgaaaatcctgggtaaactggcggaatacggtctgatcccgctgttcatcccgttcaccgactctaacgaaccgatcgttaaagaaatcaaatggatggaaaaatctcgtaaccagtctgttcgtcgtctggacaaagacatgttcatccaggcgctggaacgtttcctgtcttgggaatcttggaacctgaaagttaaagaagaatacgaaaaagttgaaaaagaacacaaaaccctggaagaacgtatcaaagaagacatccaggcgttcaaatctctggaacagtacgaaaaagaacgtcaggaacagctgctgcgtgacaccctgaacaccaacgaataccgtctgtctaaacgtggtctgcgtggttggcgtgaaatcatccagaaatggctgaaaatggacgaaaacgaaccgtctgaaaaatacctggaagttttcaaagactaccagcgtaaacacccgcgtgaagcgggtgactactctgtttacgaattcctgtctaaaaaagaaaaccacttcatctggcgtaaccacccggaatacccgtacctgtacgcgaccttctgcgaaatcgacaaaaaaaaaaaagacgcgaaacagcaggcgaccttcaccctggcggacccgatcaaccacccgctgtgggttcgtttcgaagaacgttctggttctaacctgaacaaataccgtatcctgaccgaacagctgcacaccgaaaaactgaaaaaaaaactgaccgttcagctggaccgtctgatctacccgaccgaatctggtggttgggaagaaaaaggtaaagttgacatcgttctgctgccgtctcgtcagttctacaaccagatcttcctggacatcgaagaaaaaggtaaacacgcgttcacctacaaagacgaatctatcaaattcccgctgaaaggtaccctgggtggtgcgcgtgttcagttcgaccgtgaccacctgcgtcgttacccgcacaaagttgaatctggtaacgttggtcgtatctacttcaacatgaccgttaacatcgaaccgaccgaatctccggtttctaaatctctgaaaatccaccgtgacgacttcccgaaattcgttaacttcaaaccgaaagaactgaccgaatggatcaaagactctaaaggtaaaaaactgaaatctggtatcgaatctctggaaatcggtctgcgtgttatgtctatcgacctgggtcagcgtcaggcggcggcggcgtctatcttcgaagttgttgaccagaaaccggacatcgaaggtaaactgttcttcccgatcaaaggtaccgaactgtacgcggttcaccgtgcgtctttcaacatcaaactgccgggtgaaaccctggttaaatctcgtgaagttctgcgtaaagcgcgtgaagacaacctgaaactgatgaaccagaaactgaacttcctgcgtaacgttctgcacttccagcagttcgaagacatcaccgaacgtgaaaaacgtgttaccaaatggatctctcgtcaggaaaactctgacgttccgctggtttaccaggacgaactgatccagatccgtgaactgatgtacaaaccgtacaaagactgggttgcgttcctgaaacagctgcacaaacgtctggaagttgaaatcggtaaagaagttaaacactggcgtaaatctctgtctgacggtcgtaaaggtctgtacggtatctctctgaaaaacatcgacgaaatcgaccgtacccgtaaattcctgctgcgttggtctctgcgtccgaccgaaccgggtgaagttcgtcgtctggaaccgggtcagcgtttcgcgatcgaccagctgaaccacctgaacgcgctgaaagaagaccgtctgaaaaaaatggcgaacaccatcatcatgcacgcgctgggttactgctacgacgttcgtaaaaaaaaatggcaggcgaaaaacccggcgtgccagatcatcctgttcgaagacctgtctaactacaacccgtacgaagaacgttctcgtttcgaaaactctaaactgatgaaatggtctcgtcgtgaaatcccgcgtcaggttgcgctgcagggtgaaatctacggtctgcaggttggtgaagttggtgcgcagttctcttctcgtttccacgcgaaaaccggttctccgggtatccgttgctctgttgttaccaaagaaaaactgcaggacaaccgtttcttcaaaaacctgcagcgtgaaggtcgtctgaccctggacaaaatcgcggttctgaaagaaggtgacctgtacccggacaaaggtggtgaaaaattcatctctctgtctaaagaccgtaaactggttaccacccacgcggacatcaacgcggcgcagaacctgcagaaacgtttctggacccgtacccacggtttctacaaagtttactgcaaagcgtaccaggttgacggtcagaccgtttacatcccggaatctaaagaccagaaacagaaaatcatcgaagaattcggtgaaggttacttcatcctgaaagacggtgtttacgaatggggtaacgcgggtaaactgaaaatcaaaaaaggttcttctaaacagtcttcttctgaactggttgactctgacatcctgaaagactctttcgacctggcgtctgaactgaaaggtgaaaaactgatgctgtaccgtgacccgtctggtaacgttttcccgtctgacaaatggatggcggcgggtgttttcttcggtaaactggaacgtatcctgatctctaaactgaccaaccagtactctatctctaccatcgaagacgactcttctaaacagtctatgtaagaaatcatccttagcgaaagctaaggattttttttatctgaaatgtagggagaccctcaggttaaatattcactcaggaagttattactcaggaagcaaagaggattaca

SEQ ID NO: 75 - DNA, 3982 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatccgacccgtaccatcaacctgaaactggttctgggtaaaaacccggaaaacgcgaccctgcgtcgtgcgctgttctctacccaccgtctggttaaccaggcgaccaaacgtatcgaagaattcctgctgctgtgccgtggtgaagcgtaccgtaccgttgacaacgaaggtaaagaagcggaaatcccgcgtcacgcggttcaggaagaagcgctggcgttcgcgaaagcggcgcagcgtcacaacggttgcatctctacctacgaagaccaggaaatcctggacgttctgcgtcagctgtacgaacgtctggttccgtctgttaacgaaaacaacgaagcgggtgacgcgcaggcggcgaacgcgtgggtttctccgctgatgtctgcggaatctgaaggtggtctgtctgtttacgacaaagttctggacccgccgccggtttggatgaaactgaaagaagaaaaagcgccgggttgggaagcggcgtctcagatctggatccagtctgacgaaggtcagtctctgctgaacaaaccgggttctccgccgcgttggatccgtaaactgcgttctggtcagccgtggcaggacgacttcgtttctgaccagaaaaaaaaacaggacgaactgaccaaaggtaacgcgccgctgatcaaacagctgaaagaaatgggtctgctgccgctggttaacccgttcttccgtcacctgctggacccggaaggtaaaggtgtttctccgtgggaccgtctggcggttcgtgcggcggttgcgcacttcatctcttgggaatcttggaaccaccgtacccgtgcggaatacaactctctgaaactgcgtcgtgacgaattcgaagcggcgtctgacgaattcaaagacgacttcaccctgctgcgtcagtacgaagcgaaacgtcactctaccctgaaatctatcgcgctggcggacgactctaacccgtaccgtatcggtgttcgttctctgcgtgcgtggaaccgtgttcgtgaagaatggatcgacaaaggtgcgaccgaagaacagcgtgttaccatcctgtctaaactgcagacccagctgcgtggtaaattcggtgacccggacctgttcaactggctggcgcaggaccgtcacgttcacctgtggtctccgcgtgactctgttaccccgctggttcgtatcaacgcggttgacaaagttctgcgtcgtcgtaaaccgtacgcgctgatgaccttcgcgcacccgcgtttccacccgcgttggatcctgtacgaagcgccgggtggttctaacctgcgtcagtacgcgctggactgcaccgaaaacgcgctgcacatcaccctgccgctgctggttgacgacgcgcacggtacctggatcgaaaaaaaaatccgtgttccgctggcgccgtctggtcagatccaggacctgaccctggaaaaactggaaaaaaaaaaaaaccgtctgtactaccgttctggtttccagcagttcgcgggtctggcgggtggtgcggaagttctgttccaccgtccgtacatggaacacgacgaacgttctgaagaatctctgctggaacgtccgggtgcggtttggttcaaactgaccctggacgttgcgacccaggcgccgccgaactggctggacggtaaaggtcgtgttcgtaccccgccggaagttcaccacttcaaaaccgcgctgtctaacaaatctaaacacacccgtaccctgcagccgggtctgcgtgttctgtctgttgacctgggtatgcgtaccttcgcgtcttgctctgttttcgaactgatcgaaggtaaaccggaaaccggtcgtgcgttcccggttgcggacgaacgttctatggactctccgaacaaactgtgggcgaaacacgaacgttctttcaaactgaccctgccgggtgaaaccccgtctcgtaaagaagaagaagaacgttctatcgcgcgtgcggaaatctacgcgctgaaacgtgacatccagcgtctgaaatctctgctgcgtctgggtgaagaagacaacgacaaccgtcgtgacgcgctgctggaacagttcttcaaaggttggggtgaagaagacgttgttccgggtcaggcgttcccgcgttctctgttccagggtctgggtgcggcgccgttccgttctaccccggaactgtggcgtcagcactgccagacctactacgacaaagcggaagcgtgcctggcgaaacacatctctgactggcgtaaacgtacccgtccgcgtccgacctctcgtgaaatgtggtacaaaacccgttcttaccacggtggtaaatctatctggatgctggaatacctggacgcggttcgtaaactgctgctgtcttggtctctgcgtggtcgtacctacggtgcgatcaaccgtcaggacaccgcgcgtttcggttctctggcgtctcgtctgctgcaccacatcaactctctgaaagaagaccgtatcaaaaccggtgcggactctatcgttcaggcggcgcgtggttacatcccgctgccgcacggtaaaggttgggaacagcgttacgaaccgtgccagctgatcctgttcgaagacctggcgcgttaccgtttccgtgttgaccgtccgcgtcgtgaaaactctcagctgatgcagtggaaccaccgtgcgatcgttgcggaaaccaccatgcaggcggaactgtacggtcagatcgttgaaaacaccgcggcgggtttctcttctcgtttccacgcggcgaccggtgcgccgggtgttcgttgccgtttcctgctggaacgtgacttcgacaacgacctgccgaaaccgtacctgctgcgtgaactgtcttggatgctgggtaacaccaaagttgaatctgaagaagaaaaactgcgtctgctgtctgaaaaaatccgtccgggttctctggttccgtgggacggtggtgaacagttcgcgaccctgcacccgaaacgtcagaccctgtgcgttatccacgcggacatgaacgcggcgcagaacctgcagcgtcgtttcttcggtcgttgcggtgaagcgttccgtctggtttgccagccgcacggtgacgacgttctgcgtctggcgtctaccccgggtgcgcgtctgctgggtgcgctgcagcagctggaaaacggtcagggtgcgttcgaactggttcgtgacatgggttctacctctcagatgaaccgtttcgttatgaaatctctgggtaaaaaaaaaatcaaaccgctgcaggacaacaacggtgacgacgaactggaagacgttctgtctgttctgccggaagaagacgacaccggtcgtatcaccgttttccgtgactcttctggtatcttcttcccgtgcaacgtttggatcccggcgaaacagttctggccggcggttcgtgcgatgatctggaaagttatggcgtctcactctctgggttaagaaatcatccttagcgaaagctaaggattttttttatctgaaatgtagggagaccctcaggttaaatattcactcaggaagttattactcaggaagcaaagaggattaca

SEQ ID NO: 76 - DNA, 4291 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataccaaactgcgtcaccgtcagaaaaaactgacccacgactgggcgggttctaaaaaacgtgaagttctgggttctaacggtaaactgcagaacccgctgctgatgccggttaaaaaaggtcaggttaccgaattccgtaaagcgttctctgcgtacgcgcgtgcgaccaaaggtgaaatgaccgacggtcgtaaaaacatgttcacccactctttcgaaccgttcaaaaccaaaccgtctctgcaccagtgcgaactggcggacaaagcgtaccagtctctgcactcttacctgccgggttctctggcgcacttcctgctgtctgcgcacgcgctgggtttccgtatcttctctaaatctggtgaagcgaccgcgttccaggcgtcttctaaaatcgaagcgtacgaatctaaactggcgtctgaactggcgtgcgttgacctgtctatccagaacctgaccatctctaccctgttcaacgcgctgaccacctctgttcgtggtaaaggtgaagaaacctctgcggacccgctgatcgcgcgtttctacaccctgctgaccggtaaaccgctgtctcgtgacacccagggtccggaacgtgacctggcggaagttatctctcgtaaaatcgcgtcttctttcggtacctggaaagaaatgaccgcgaacccgctgcagtctctgcagttcttcgaagaagaactgcacgcgctggacgcgaacgtttctctgtctccggcgttcgacgttctgatcaaaatgaacgacctgcagggtgacctgaaaaaccgtaccatcgttttcgacccggacgcgccggttttcgaatacaacgcggaagacccggcggacatcatcatcaaactgaccgcgcgttacgcgaaagaagcggttatcaaaaaccagaacgttggtaactacgttaaaaacgcgatcaccaccaccaacgcgaacggtctgggttggctgctgaacaaaggtctgtctctgctgccggtttctaccgacgacgaactgctggaattcatcggtgttgaacgttctcacccgtcttgccacgcgctgatcgaactgatcgcgcagctggaagcgccggaactgttcgaaaaaaacgttttctctgacacccgttctgaagttcagggtatgatcgactctgcggtttctaaccacatcgcgcgtctgtcttcttctcgtaactctctgtctatggactctgaagaactggaacgtctgatcaaatctttccagatccacaccccgcactgctctctgttcatcggtgcgcagtctctgtctcagcagctggaatctctgccggaagcgctgcagtctggtgttaactctgcggacatcctgctgggttctacccagtacatgctgaccaactctctggttgaagaatctatcgcgacctaccagcgtaccctgaaccgtatcaactacctgtctggtgttgcgggtcagatcaacggtgcgatcaaacgtaaagcgatcgacggtgaaaaaatccacctgccggcggcgtggtctgaactgatctctctgccgttcatcggtcagccggttatcgacgttgaatctgacctggcgcacctgaaaaaccagtaccagaccctgtctaacgaattcgacaccctgatctctgcgctgcagaaaaacttcgacctgaacttcaacaaagcgctgctgaaccgtacccagcacttcgaagcgatgtgccgttctaccaaaaaaaacgcgctgtctaaaccggaaatcgtttcttaccgtgacctgctggcgcgtctgacctcttgcctgtaccgtggttctctggttctgcgtcgtgcgggtatcgaagttctgaaaaaacacaaaatcttcgaatctaactctgaactgcgtgaacacgttcacgaacgtaaacacttcgttttcgtttctccgctggaccgtaaagcgaaaaaactgctgcgtctgaccgactctcgtccggacctgctgcacgttatcgacgaaatcctgcagcacgacaacctggaaaacaaagaccgtgaatctctgtggctggttcgttctggttacctgctggcgggtctgccggaccagctgtcttcttctttcatcaacctgccgatcatcacccagaaaggtgaccgtcgtctgatcgacctgatccagtacgaccagatcaaccgtgacgcgttcgttatgctggttacctctgcgttcaaatctaacctgtctggtctgcagtaccgtgcgaacaaacagtctttcgttgttacccgtaccctgtctccgtacctgggttctaaactggtttacgttccgaaagacaaagactggctggttccgtctcagatgttcgaaggtcgtttcgcggacatcctgcagtctgactacatggtttggaaagacgcgggtcgtctgtgcgttatcgacaccgcgaaacacctgtctaacatcaaaaaatctgttttctcttctgaagaagttctggcgttcctgcgtgaactgccgcaccgtaccttcatccagaccgaagttcgtggtctgggtgttaacgttgacggtatcgcgttcaacaacggtgacatcccgtctctgaaaaccttctctaactgcgttcaggttaaagtttctcgtaccaacacctctctggttcagaccctgaaccgttggttcgaaggtggtaaagtttctccgccgtctatccagttcgaacgtgcgtactacaaaaaagacgaccagatccacgaagacgcggcgaaacgtaaaatccgtttccagatgccggcgaccgaactggttcacgcgtctgacgacgcgggttggaccccgtcttacctgctgggtatcgacccgggtgaatacggtatgggtctgtctctggtttctatcaacaacggtgaagttctggactctggtttcatccacatcaactctctgatcaacttcgcgtctaaaaaatctaaccaccagaccaaagttgttccgcgtcagcagtacaaatctccgtacgcgaactacctggaacagtctaaagactctgcggcgggtgacatcgcgcacatcctggaccgtctgatctacaaactgaacgcgctgccggttttcgaagcgctgtctggtaactctcagtctgcggcggaccaggtttggaccaaagttctgtctttctacacctggggtgacaacgacgcgcagaactctatccgtaaacagcactggttcggtgcgtctcactgggacatcaaaggtatgctgcgtcagccgccgaccgaaaaaaaaccgaaaccgtacatcgcgttcccgggttctcaggtttcttcttacggtaactctcagcgttgctcttgctgcggtcgtaacccgatcgaacagctgcgtgaaatggcgaaagacacctctatcaaagaactgaaaatccgtaactctgaaatccagctgttcgacggtaccatcaaactgttcaacccggacccgtctaccgttatcgaacgtcgtcgtcacaacctgggtccgtctcgtatcccggttgcggaccgtaccttcaaaaacatctctccgtcttctctggaattcaaagaactgatcaccatcgtttctcgttctatccgtcactctccggaattcatcgcgaaaaaacgtggtatcggttctgaatacttctgcgcgtactctgactgcaactcttctctgaactctgaagcgaacgcggcggcgaacgttgcgcagaaattccagaaacagctgttcttcgaactgtaagaaatcatccttagcgaaagctaaggattttttttatctgaaatgtagggagaccctcaggttaaatattcactcaggaagttattactcaggaagcaaagaggattaca

SEQ ID NO: 77 - DNA, 4396 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataaacgtatcctgaactctctgaaagttgcggcgctgcgtctgctgttccgtggtaaaggttctgaactggttaaaaccgttaaatacccgctggtttctccggttcagggtgcggttgaagaactggcggaagcgatccgtcacgacaacctgcacctgttcggtcagaaagaaatcgttgacctgatggaaaaagacgaaggtacccaggtttactctgttgttgacttctggctggacaccctgcgtctgggtatgttcttctctccgtctgcgaacgcgctgaaaatcaccctgggtaaattcaactctgaccaggtttctccgttccgtaaagttctggaacagtctccgttcttcctggcgggtcgtctgaaagttgaaccggcggaacgtatcctgtctgttgaaatccgtaaaatcggtaaacgtgaaaaccgtgttgaaaactacgcggcggacgttgaaacctgcttcatcggtcagctgtcttctgacgaaaaacagtctatccagaaactggcgaacgacatctgggactctaaagaccacgaagaacagcgtatgctgaaagcggacttcttcgcgatcccgctgatcaaagacccgaaagcggttaccgaagaagacccggaaaacgaaaccgcgggtaaacagaaaccgctggaactgtgcgtttgcctggttccggaactgtacacccgtggtttcggttctatcgcggacttcctggttcagcgtctgaccctgctgcgtgacaaaatgtctaccgacaccgcggaagactgcctggaatacgttggtatcgaagaagaaaaaggtaacggtatgaactctctgctgggtaccttcctgaaaaacctgcagggtgacggtttcgaacagatcttccagttcatgctgggttcttacgttggttggcagggtaaagaagacgttctgcgtgaacgtctggacctgctggcggaaaaagttaaacgtctgccgaaaccgaaattcgcgggtgaatggtctggtcaccgtatgttcctgcacggtcagctgaaatcttggtcttctaacttcttccgtctgttcaacgaaacccgtgaactgctggaatctatcaaatctgacatccagcacgcgaccatgctgatctcttacgttgaagaaaaaggtggttaccacccgcagctgctgtctcagtaccgtaaactgatggaacagctgccggcgctgcgtaccaaagttctggacccggaaatcgaaatgacccacatgtctgaagcggttcgttcttacatcatgatccacaaatctgttgcgggtttcctgccggacctgctggaatctctggaccgtgacaaagaccgtgaattcctgctgtctatcttcccgcgtatcccgaaaatcgacaaaaaaaccaaagaaatcgttgcgtgggaactgccgggtgaaccggaagaaggttacctgttcaccgcgaacaacctgttccgtaacttcctggaaaacccgaaacacgttccgcgtttcatggcggaacgtatcccggaagactggacccgtctgcgttctgcgccggtttggttcgacggtatggttaaacagtggcagaaagttgttaaccagctggttgaatctccgggtgcgctgtaccagttcaacgaatctttcctgcgtcagcgtctgcaggcgatgctgaccgtttacaaacgtgacctgcagaccgaaaaattcctgaaactgctggcggacgtttgccgtccgctggttgacttcttcggtctgggtggtaacgacatcatcttcaaatcttgccaggacccgcgtaaacagtggcagaccgttatcccgctgtctgttccggcggacgtttacaccgcgtgcgaaggtctggcgatccgtctgcgtgaaaccctgggtttcgaatggaaaaacctgaaaggtcacgaacgtgaagacttcctgcgtctgcaccagctgctgggtaacctgctgttctggatccgtgacgcgaaactggttgttaaactggaagactggatgaacaacccgtgcgttcaggaatacgttgaagcgcgtaaagcgatcgacctgccgctggaaatcttcggtttcgaagttccgatcttcctgaacggttacctgttctctgaactgcgtcagctggaactgctgctgcgtcgtaaatctgttatgacctcttactctgttaaaaccaccggttctccgaaccgtctgttccagctggtttacctgccgctgaacccgtctgacccggaaaaaaaaaactctaacaacttccaggaacgtctggacaccccgaccggtctgtctcgtcgtttcctggacctgaccctggacgcgttcgcgggtaaactgctgaccgacccggttacccaggaactgaaaaccatggcgggtttctacgaccacctgttcggtttcaaactgccgtgcaaactggcggcgatgtctaaccacccgggttcttcttctaaaatggttgttctggcgaaaccgaaaaaaggtgttgcgtctaacatcggtttcgaaccgatcccggacccggcgcacccggttttccgtgttcgttcttcttggccggaactgaaatacctggaaggtctgctgtacctgccggaagacaccccgctgaccatcgaactggcggaaacctctgtttcttgccagtctgtttcttctgttgcgttcgacctgaaaaacctgaccaccatcctgggtcgtgttggtgaattccgtgttaccgcggaccagccgttcaaactgaccccgatcatcccggaaaaagaagaatctttcatcggtaaaacctacctgggtctggacgcgggtgaacgttctggtgttggtttcgcgatcgttaccgttgacggtgacggttacgaagttcagcgtctgggtgttcacgaagacacccagctgatggcgctgcagcaggttgcgtctaaatctctgaaagaaccggttttccagccgctgcgtaaaggtaccttccgtcagcaggaacgtatccgtaaatctctgcgtggttgctactggaacttctaccacgcgctgatgatcaaataccgtgcgaaagttgttcacgaagaatctgttggttcttctggtctggttggtcagtggctgcgtgcgttccagaaagacctgaaaaaagcggacgttctgccgaaaaaaggtggtaaaaacggtgttgacaaaaaaaaacgtgaatcttctgcgcaggacaccctgtggggtggtgcgttctctaaaaaagaagaacagcagatcgcgttcgaagttcaggcggcgggttcttctcagttctgcctgaaatgcggttggtggttccagctgggtatgcgtgaagttaaccgtgttcaggaatctggtgttgttctggactggaaccgttctatcgttaccttcctgatcgaatcttctggtgaaaaagtttacggtttctctccgcagcagctggaaaaaggtttccgtccggacatcgaaaccttcaaaaaaatggttcgtgacttcatgcgtccgccgatgttcgaccgtaaaggtcgtccggcggcggcgtacgaacgtttcgttctgggtcgtcgtcaccgtcgttaccgtttcgacaaagttttcgaagaacgtttcggtcgttctgcgctgttcatctgcccgcgtgttggttgcggtaacttcgaccactcttctgaacagtctgcggttgttctggcgctgatcggttacatcgcggacaaagaaggtatgtctggtaaaaaactggtttacgttcgtctggcggaactgatggcggaatggaaactgaaaaaactggaacgttctcgtgttgaagaacagtcttctgcgcagtaagaaatcatccttagcgaaagctaaggattttttttatctgaaatgtagggagaccctcaggttaaatattcactcaggaagttattactcaggaagcaaagaggattaca

SEQ ID NO: 78 - DNA, 4111 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatgcggaatctaaacagatgcagtgccgtaaatgcggtgcgtctatgaaatacgaagttatcggtctgggtaaaaaatcttgccgttacatgtgcccggactgcggtaaccacacctctgcgcgtaaaatccagaacaaaaaaaaacgtgacaaaaaatacggttctgcgtctaaagcgcagtctcagcgtatcgcggttgcgggtgcgctgtacccggacaaaaaagttcagaccatcaaaacctacaaatacccggcggacctgaacggtgaagttcacgactctggtgttgcggaaaaaatcgcgcaggcgatccaggaagacgaaatcggtctgctgggtccgtcttctgaatacgcgtgctggatcgcgtctcagaaacagtctgaaccgtactctgttgttgacttctggttcgacgcggtttgcgcgggtggtgttttcgcgtactctggtgcgcgtctgctgtctaccgttctgcagctgtctggtgaagaatctgttctgcgtgcggcgctggcgtcttctccgttcgttgacgacatcaacctggcgcaggcggaaaaattcctggcggtttctcgtcgtaccggtcaggacaaactgggtaaacgtatcggtgaatgcttcgcggaaggtcgtctggaagcgctgggtatcaaagaccgtatgcgtgaattcgttcaggcgatcgacgttgcgcagaccgcgggtcagcgtttcgcggcgaaactgaaaatcttcggtatctctcagatgccggaagcgaaacagtggaacaacgactctggtctgaccgtttgcatcctgccggactactacgttccggaagaaaaccgtgcggaccagctggttgttctgctgcgtcgtctgcgtgaaatcgcgtactgcatgggtatcgaagacgaagcgggtttcgaacacctgggtatcgacccgggtgcgctgtctaacttctctaacggtaacccgaaacgtggtttcctgggtcgtctgctgaacaacgacatcatcgcgctggcgaacaacatgtctgcgatgaccccgtactgggaaggtcgtaaaggtgaactgatcgaacgtctggcgtggctgaaacaccgtgcggaaggtctgtacctgaaagaaccgcacttcggtaactcttgggcggaccaccgttctcgtatcttctctcgtatcgcgggttggctgtctggttgcgcgggtaaactgaaaatcgcgaaagaccagatctctggtgttcgtaccgacctgttcctgctgaaacgtctgctggacgcggttccgcagtctgcgccgtctccggacttcatcgcgtctatctctgcgctggaccgtttcctggaagcggcggaatcttctcaggacccggcggaacaggttcgtgcgctgtacgcgttccacctgaacgcgccggcggttcgttctatcgcgaacaaagcggttcagcgttctgactctcaggaatggctgatcaaagaactggacgcggttgaccacctggaattcaacaaagcgttcccgttcttctctgacaccggtaaaaaaaaaaaaaaaggtgcgaactctaacggtgcgccgtctgaagaagaatacaccgaaaccgaatctatccagcagccggaagacgcggaacaggaagttaacggtcaggaaggtaacggtgcgtctaaaaaccagaaaaaattccagcgtatcccgcgtttcttcggtgaaggttctcgttctgaataccgtatcctgaccgaagcgccgcagtacttcgacatgttctgcaacaacatgcgtgcgatcttcatgcagctggaatctcagccgcgtaaagcgccgcgtgacttcaaatgcttcctgcagaaccgtctgcagaaactgtacaaacagaccttcctgaacgcgcgttctaacaaatgccgtgcgctgctggaatctgttctgatctcttggggtgaattctacacctacggtgcgaacgaaaaaaaattccgtctgcgtcacgaagcgtctgaacgttcttctgacccggactacgttgttcagcaggcgctggaaatcgcgcgtcgtctgttcctgttcggtttcgaatggcgtgactgctctgcgggtgaacgtgttgacctggttgaaatccacaaaaaagcgatctctttcctgctggcgatcacccaggcggaagtttctgttggttcttacaactggctgggtaactctaccgtttctcgttacctgtctgttgcgggtaccgacaccctgtacggtacccagctggaagaattcctgaacgcgaccgttctgtctcagatgcgtggtctggcgatccgtctgtcttctcaggaactgaaagacggtttcgacgttcagctggaatcttcttgccaggacaacctgcagcacctgctggtttaccgtgcgtctcgtgacctggcggcgtgcaaacgtgcgacctgcccggcggaactggacccgaaaatcctggttctgccggttggtgcgttcatcgcgtctgttatgaaaatgatcgaacgtggtgacgaaccgctggcgggtgcgtacctgcgtcaccgtccgcactctttcggttggcagatccgtgttcgtggtgttgcggaagttggtatggaccagggtaccgcgctggcgttccagaaaccgaccgaatctgaaccgttcaaaatcaaaccgttctctgcgcagtacggtccggttctgtggctgaactcttcttcttactctcagtctcagtacctggacggtttcctgtctcagccgaaaaactggtctatgcgtgttctgccgcaggcgggttctgttcgtgttgaacagcgtgttgcgctgatctggaacctgcaggcgggtaaaatgcgtctggaacgttctggtgcgcgtgcgttcttcatgccggttccgttctctttccgtccgtctggttctggtgacgaagcggttctggcgccgaaccgttacctgggtctgttcccgcactctggtggtatcgaatacgcggttgttgacgttctggactctgcgggtttcaaaatcctggaacgtggtaccatcgcggttaacggtttctctcagaaacgtggtgaacgtcaggaagaagcgcaccgtgaaaaacagcgtcgtggtatctctgacatcggtcgtaaaaaaccggttcaggcggaagttgacgcggcgaacgaactgcaccgtaaatacaccgacgttgcgacccgtctgggttgccgtatcgttgttcagtgggcgccgcagccgaaaccgggtaccgcgccgaccgcgcagaccgtttacgcgcgtgcggttcgtaccgaagcgccgcgttctggtaaccaggaagaccacgcgcgtatgaaatcttcttggggttacacctggggtacctactgggaaaaacgtaaaccggaagacatcctgggtatctctacccaggtttactggaccggtggtatcggtgaatcttgcccggcggttgcggttgcgctgctgggtcacatccgtgcgacctctacccagaccgaatgggaaaaagaagaagttgttttcggtcgtctgaaaaaattcttcccgtcttaagaaatcatccttagcgaaagctaaggattttttttatctgaaatgtagggagaccctcaggttaaatattcactcaggaagttattactcaggaagcaaagaggattaca

SEQ ID NO: 79 - DNA, 3493 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatgaaaaacgtatcaacaaaatccgtaaaaaactgtctgcggacaacgcgaccaaaccggtttctcgttctggtccgatgaaaaccctgctggttcgtgttatgaccgacgacctgaaaaaacgtctggaaaaacgtcgtaaaaaaccggaagttatgccgcaggttatctctaacaacgcggcgaacaacctgcgtatgctgctggacgactacaccaaaatgaaagaagcgatcctgcaggtttactggcaggaattcaaagacgaccacgttggtctgatgtgcaaattcgcgcagccggcgtctaaaaaaatcgaccagaacaaactgaaaccggaaatggacgaaaaaggtaacctgaccaccgcgggtttcgcgtgctctcagtgcggtcagccgctgttcgtttacaaactggaacaggtttctgaaaaaggtaaagcgtacaccaactacttcggtcgttgcaacgttgcggaacacgaaaaactgatcctgctggcgcagctgaaaccggaaaaagactctgacgaagcggttacctactctctgggtaaattcggtcagcgtgcgctggacttctactctatccacgttaccaaagaatctacccacccggttaaaccgctggcgcagatcgcgggtaaccgttacgcgtctggtccggttggtaaagcgctgtctgacgcgtgcatgggtaccatcgcgtctttcctgtctaaataccaggacatcatcatcgaacaccagaaagttgttaaaggtaaccagaaacgtctggaatctctgcgtgaactggcgggtaaagaaaacctggaatacccgtctgttaccctgccgccgcagccgcacaccaaagaaggtgttgacgcgtacaacgaagttatcgcgcgtgttcgtatgtgggttaacctgaacctgtggcagaaactgaaactgtctcgtgacgacgcgaaaccgctgctgcgtctgaaaggtttcccgtctttcccggttgttgaacgtcgtgaaaacgaagttgactggtggaacaccatcaacgaagttaaaaaactgatcgacgcgaaacgtgacatgggtcgtgttttctggtctggtgttaccgcggaaaaacgtaacaccatcctggaaggttacaactacctgccgaacgaaaacgaccacaaaaaacgtgaaggttctctggaaaacccgaaaaaaccggcgaaacgtcagttcggtgacctgctgctgtacctggaaaaaaaatacgcgggtgactggggtaaagttttcgacgaagcgtgggaacgtatcgacaaaaaaatcgcgggtctgacctctcacatcgaacgtgaagaagcgcgtaacgcggaagacgcgcagtctaaagcggttctgaccgactggctgcgtgcgaaagcgtctttcgttctggaacgtctgaaagaaatggacgaaaaagaattctacgcgtgcgaaatccagctgcagaaatggtacggtgacctgcgtggtaacccgttcgcggttgaagcggaaaaccgtgttgttgacatctctggtttctctatcggttctgacggtcactctatccagtaccgtaacctgctggcgtggaaatacctggaaaacggtaaacgtgaattctacctgctgatgaactacggtaaaaaaggtcgtatccgtttcaccgacggtaccgacatcaaaaaatctggtaaatggcagggtctgctgtacggtggtggtaaagcgaaagttatcgacctgaccttcgacccggacgacgaacagctgatcatcctgccgctggcgttcggtacccgtcagggtcgtgaattcatctggaacgacctgctgtctctggaaaccggtctgatcaaactggcgaacggtcgtgttatcgaaaaaaccatctacaacaaaaaaatcggtcgtgacgaaccggcgctgttcgttgcgctgaccttcgaacgtcgtgaagttgttgacccgtctaacatcaaaccggttaacctgatcggtgttgaccgtggtgaaaacatcccggcggttatcgcgctgaccgacccggaaggttgcccgctgccggaattcaaagactcttctggtggtccgaccgacatcctgcgtatcggtgaaggttacaaagaaaaacagcgtgcgatccaggcggcgaaagaagttgaacagcgtcgtgcgggtggttactctcgtaaattcgcgtctaaatctcgtaacctggcggacgacatggttcgtaactctgcgcgtgacctgttctaccacgcggttacccacgacgcggttctggttttcgaaaacctgtctcgtggtttcggtcgtcagggtaaacgtaccttcatgaccgaacgtcagtacaccaaaatggaagactggctgaccgcgaaactggcgtacgaaggtctgacctctaaaacctacctgtctaaaaccctggcgcagtacacctctaaaacctgctctaactgcggtttcaccatcaccaccgcggactacgacggtatgctggttcgtctgaaaaaaacctctgacggttgggcgaccaccctgaacaacaaagaactgaaagcggaaggtcagatcacctactacaaccgttacaaacgtcagaccgttgaaaaagaactgtctgcggaactggaccgtctgtctgaagaatctggtaacaacgacatctctaaatggaccaaaggtcgtcgtgacgaagcgctgttcctgctgaaaaaacgtttctctcaccgtccggttcaggaacagttcgtttgcctggactgcggtcacgaagttcacgcggacgaacaggcggcgctgaacatcgcgcgttcttggctgttcctgaactctaactctaccgaattcaaatcttacaaatctggtaaacagccgttcgttggtgcgtggcaggcgttctacaaacgtcgtctgaaagaagtttggaaaccgaacgcgtaagaaatcatccttagcgaaagctaaggattttttttatctgaaatgtagggagaccctcaggttaaatattcactcaggaagttattactcaggaagcaaagaggattaca

SEQ ID NO: 80 - DNA, 3451 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataaacgtatcaacaaaatccgtcgtcgtctggttaaagactctaacaccaaaaaagcgggtaaaaccggtccgatgaaaaccctgctggttcgtgttatgaccccggacctgcgtgaacgtctggaaaacctgcgtaaaaaaccggaaaacatcccgcagccgatctctaacacctctcgtgcgaacctgaacaaactgctgaccgactacaccgaaatgaaaaaagcgatcctgcacgtttactgggaagaattccagaaagacccggttggtctgatgtctcgtgttgcgcagccggcgccgaaaaacatcgaccagcgtaaactgatcccggttaaagacggtaacgaacgtctgacctcttctggtttcgcgtgctctcagtgctgccagccgctgtacgtttacaaactggaacaggttaacgacaaaggtaaaccgcacaccaactacttcggtcgttgcaacgtttctgaacacgaacgtctgatcctgctgtctccgcacaaaccggaagcgaacgacgaactggttacctactctctgggtaaattcggtcagcgtgcgctggacttctactctatccacgttacccgtgaatctaaccacccggttaaaccgctggaacagatcggtggtaactcttgcgcgtctggtccggttggtaaagcgctgtctgacgcgtgcatgggtgcggttgcgtctttcctgaccaaataccaggacatcatcctggaacaccagaaagttatcaaaaaaaacgaaaaacgtctggcgaacctgaaagacatcgcgtctgcgaacggtctggcgttcccgaaaatcaccctgccgccgcagccgcacaccaaagaaggtatcgaagcgtacaacaacgttgttgcgcagatcgttatctgggttaacctgaacctgtggcagaaactgaaaatcggtcgtgacgaagcgaaaccgctgcagcgtctgaaaggtttcccgtctttcccgctggttgaacgtcaggcgaacgaagttgactggtgggacatggtttgcaacgttaaaaaactgatcaacgaaaaaaaagaagacggtaaagttttctggcagaacctggcgggttacaaacgtcaggaagcgctgctgccgtacctgtcttctgaagaagaccgtaaaaaaggtaaaaaattcgcgcgttaccagttcggtgacctgctgctgcacctggaaaaaaaacacggtgaagactggggtaaagtttacgacgaagcgtgggaacgtatcgacaaaaaagttgaaggtctgtctaaacacatcaaactggaagaagaacgtcgttctgaagacgcgcagtctaaagcggcgctgaccgactggctgcgtgcgaaagcgtctttcgttatcgaaggtctgaaagaagcggacaaagacgaattctgccgttgcgaactgaaactgcagaaatggtacggtgacctgcgtggtaaaccgttcgcgatcgaagcggaaaactctatcctggacatctctggtttctctaaacagtacaactgcgcgttcatctggcagaaagacggtgttaaaaaactgaacctgtacctgatcatcaactacttcaaaggtggtaaactgcgtttcaaaaaaatcaaaccggaagcgttcgaagcgaaccgtttctacaccgttatcaacaaaaaatctggtgaaatcgttccgatggaagttaacttcaacttcgacgacccgaacctgatcatcctgccgctggcgttcggtaaacgtcagggtcgtgaattcatctggaacgacctgctgtctctggaaaccggttctctgaaactggcgaacggtcgtgttatcgaaaaaaccctgtacaaccgtcgtacccgtcaggacgaaccggcgctgttcgttgcgctgaccttcgaacgtcgtgaagttctggactcttctaacatcaaaccgatgaacctgatcggtatcgaccgtggtgaaaacatcccggcggttatcgcgctgaccgacccggaaggttgcccgctgtctcgtttcaaagactctctgggtaacccgacccacatcctgcgtatcggtgaatcttacaaagaaaaacagcgtaccatccaggcggcgaaagaagttgaacagcgtcgtgcgggtggttactctcgtaaatacgcgtctaaagcgaaaaacctggcggacgacatggttcgtaacaccgcgcgtgacctgctgtactacgcggttacccaggacgcgatgctgatcttcgaaaacctgtctcgtggtttcggtcgtcagggtaaacgtaccttcatggcggaacgtcagtacacccgtatggaagactggctgaccgcgaaactggcgtacgaaggtctgccgtctaaaacctacctgtctaaaaccctggcgcagtacacctctaaaacctgctctaactgcggtttcaccatcacctctgcggactacgaccgtgttctggaaaaactgaaaaaaaccgcgaccggttggatgaccaccatcaacggtaaagaactgaaagttgaaggtcagatcacctactacaaccgttacaaacgtcagaacgttgttaaagacctgtctgttgaactggaccgtctgtctgaagaatctgttaacaacgacatctcttcttggaccaaaggtcgttctggtgaagcgctgtctctgctgaaaaaacgtttctctcaccgtccggttcaggaaaaattcgtttgcctgaactgcggtttcgaaacccacgcggacgaacaggcggcgctgaacatcgcgcgttcttggctgttcctgcgttctcaggaatacaaaaaataccagaccaacaaaaccaccggtaacaccgacaaacgtgcgttcgttgaaacctggcagtctttctaccgtaaaaaactgaaagaagtttggaaaccggaaatcatccttagcgaaagctaaggattttttttatctgaaatgtagggagaccctcaggttaaatattcactcaggaagttattactcaggaagcaaagaggattaca

SEQ ID NO: 81 - DNA, 329 bp, Artificial Sequence
  Description of Artificial Sequence: Synthetic polynucleotide
tgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatatacc

SEQ ID NO: 82 - DNA, 286 bp, Artificial Sequence
  Description of Artificial Sequence: Synthetic polynucleotide
tgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggtagcggatcctacctgac

SEQ ID NO: 83 - DNA, 297 bp, Artificial Sequence
  Description of Artificial Sequence: Synthetic polynucleotide
aatcaggagagcgttttcaatcctacctctggcgcagttgatatgtcaaacaggtttctagagcacagctaacaccacgtcgtccctatctgctgccctaggtctatgagtggttgctggataactttacgggcatgcataaggctcgtaatatatattcagggagaccacaacggtttccctctacaaataattttgtttaacttttactagagctagcagtaatacgactcactataggggtctcatctcgtgtgagataggcggagatacgaactttaagaggaggatatacca

SEQ ID NO: 84 - DNA, 36 bp, Artificial Sequence
  Description of Artificial Sequence: Synthetic oligonucleotide
gtttgagagatatgtaaattcaaaggataatcaaac

SEQ ID NO: 85 - DNA, 29 bp, Artificial Sequence
  Description of Artificial Sequence: Synthetic oligonucleotide
actacattttttaagacctaattttgagt

SEQ ID NO: 86 - DNA, 35 bp, Artificial Sequence
  Description of Artificial Sequence: Synthetic oligonucleotide
ctcaaaactcattcgaatctctactctttgtagat

SEQ ID NO: 87 - DNA, 36 bp, Artificial Sequence
  Description of Artificial Sequence: Synthetic oligonucleotide
ctctagcaggcctggcaaatttctactgttgtagat

SEQ ID NO: 88 - DNA, 38 bp, Artificial Sequence
  Description of Artificial Sequence: Synthetic oligonucleotide
ccgtctaaaactcattcagaatttctactagtgtagat

SEQ ID NO: 89 - DNA, 32 bp, Artificial Sequence
  Description of Artificial Sequence: Synthetic oligonucleotide
gtctaggtactctctttaatttctactattgt

SEQ ID NO: 90 - DNA, 35 bp, Artificial Sequence
  Description of Artificial Sequence: Synthetic oligonucleotide
gttaagttatatagaataatttctactgttgtaga

SEQ ID NO: 91 - DNA, 33 bp, Artificial Sequence
  Description of Artificial Sequence: Synthetic oligonucleotide
gtttaaaaccactttaaaatttctactattgta

SEQ ID NO: 92 - DNA, 122 bp, Artificial Sequence
  Description of Artificial Sequence: Synthetic polynucleotide
gtttgagaatgatgtaaaaatgtatggtacacagaaatgttttaataccatatttttacatcactctcaaacatacatctcttgttactgtttatcgtatccagattaaatttcacgttttt

SEQ ID NO: 93 - DNA, 36 bp, Artificial Sequence
  Description of Artificial Sequence: Synthetic oligonucleotide
ctctacaactgataaagaatttctacttttgtagat

SEQ ID NO: 94 - DNA, 36 bp, Artificial Sequence
  Description of Artificial Sequence: Synthetic oligonucleotide
gtctggccccaaattttaatttctactgttgtagat

SEQ ID NO: 95 - DNA, 35 bp, Artificial Sequence
  Description of Artificial Sequence: Synthetic oligonucleotide
gtcaaaagacctttttaatttctactcttgtagat

SEQ ID NO: 96 - DNA, 85 bp, Artificial Sequence
  Description of Artificial Sequence: Synthetic oligonucleotide
gtctagaggacagaatttttcaacgggtgtgccaatggccactttccaggtggcaaagcccgttgagcttctacggaagtggcac

SEQ ID NO: 97 - DNA, 105 bp, Artificial Sequence
  Description of Artificial Sequence: Synthetic polynucleotide
cgaggttctgtcttttggtcaggacaaccgtctagctataagtgctgcaggggtgtgagaaactcctattgctggacgatgtctcttttaacgaggcattagcac

SEQ ID NO: 98 - DNA, 119 bp, Artificial Sequence
  Description of Artificial Sequence: Synthetic polynucleotide
gaacgagggacgttttgtctccaatgattttgctatgacgacctcgaactgtgccttcaagtctgaggcgaaaaagaaatggaaaaaagtgtctcatcgctctacctcgtagttagagg

SEQ ID NO: 99 - DNA, 23 bp, Artificial Sequence
  Description of Artificial Sequence: Synthetic oligonucleotide
aattactgatgttgtgatgaagg

SEQ ID NO: 100 - DNA, 23 bp, Artificial Sequence
  Description of Artificial Sequence: Synthetic oligonucleotide
tataccataaggatttaaagact

SEQ ID NO: 101 - DNA, 25 bp, Artificial Sequence
  Description of Artificial Sequence: Synthetic oligonucleotide
gtctttactctcacctttccacctg

SEQ ID NO: 102 - DNA, 37 bp, Artificial Sequence
  Description of Artificial Sequence: Synthetic oligonucleotide
atttgaaggtatctccgataagtaaaacgcatcaaag

SEQ ID NO: 103 - DNA, 37 bp, Artificial Sequence
  Description of Artificial Sequence: Synthetic oligonucleotide
gtttgaagatatctccgataaataagaagcatcaaag

SEQ ID NO: 104 - DNA, 36 bp, Artificial Sequence
  Description of Artificial Sequence: Synthetic oligonucleotide
ttgttttaataccatatttttacatcactctcaaac

SEQ ID NO: 105 - DNA, 103 bp, Artificial Sequence
  Description of Artificial Sequence: Synthetic polynucleotide
aaagaacgctcgctcagtgttctgacctttcgagcgcctgttcagggcgaaaaccctgggaggcgctcgaatcataggtgggacaagggattcgcggcgaaaa

SEQ ID NO: 106 - DNA, 122 bp, Artificial Sequence; identical to SEQ ID NO: 92
  Description of Artificial Sequence: Synthetic polynucleotide

SEQ ID NO: 107 - DNA, 85 bp, Artificial Sequence; identical to SEQ ID NO: 96
  Description of Artificial Sequence: Synthetic oligonucleotide

SEQ ID NO: 108 - protein, 1300 aa, Artificial Sequence
  Description of Artificial Sequence: Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 109 - protein, 1300 aa, Artificial Sequence
  Description of Artificial Sequence: Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSDDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILANFAAIPMIFDEIAQNKDNLAQISLKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGNPQKGYEKFEFNIEDCRKFIDFYKESISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEHNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 110 - protein, 1368 aa, Artificial Sequence [sequence omitted]

SEQ ID NO: 111 - protein, 7 aa, Simian virus 40
PKKKRKV

SEQ ID NO: 112 - protein, 16 aa, Unknown
  Description of Unknown: Nucleoplasmin bipartite NLS sequence
KRPAATKKAGQAKKKK

SEQ ID NO: 113 - protein, 9 aa, Unknown
  Description of Unknown: C-myc NLS sequence
PAAKRVKLD

SEQ ID NO: 114 - protein, 11 aa, Unknown
  Description of Unknown: C-myc NLS sequence
RQRRNELKRSP

SEQ ID NO: 115 - protein, 38 aa, Homo sapiens
NQSSNFGPMKGGNFGGRSSGPYGGGGQYFAKPRNQGGY

SEQ ID NO: 116 - protein, 42 aa, Unknown
  Description of Unknown: IBB domain from importin-alpha sequence
RMRIZFKNKGKDTAELRRRRVEVSVELRKAKKDEQILKRRNV

SEQ ID NO: 117 - protein, 8 aa, Unknown
  Description of Unknown: Myoma T protein sequence
VSRKRPRP

SEQ ID NO: 118 - protein, 8 aa, Unknown
  Description of Unknown: Myoma T protein sequence
PPKKARED

SEQ ID NO: 119 - protein, 8 aa, Homo sapiens
PQPKKKPL

SEQ ID NO: 120 - protein, 12 aa, Mus musculus
SALIKKKKKMAP

SEQ ID NO: 121 - protein, 5 aa, Influenza virus
DRLRR

SEQ ID NO: 122 - protein, 7 aa, Influenza virus
PKQKKRK

SEQ ID NO: 123 - protein, 10 aa, Hepatitis delta virus
RKLKKKIKKL

SEQ ID NO: 124 - protein, 10 aa, Mus musculus
REKKKFLKRR

SEQ ID NO: 125 - protein, 20 aa, Homo sapiens
KRKGDEVDGVDEVAKKKSKK

SEQ ID NO: 126 - protein, 17 aa, Homo sapiens
RKCLQAGMNLEARKTKK

SEQ ID NO: 127 - DNA, 4098 bp, Artificial Sequence
  Description of Artificial Sequence: Synthetic polynucleotide
atgggtaagatgtattatctgggtttggatataggcactaactctgtgggatatgcagtaactgatccctcgtatcacttgttaaagttcaaaggcgaacccatgtggggagcacatgtatttgctgcgggtaatcagagtgccgaaaggcgatctttcagaacatccaggaggcgattagataggagacagcaaagagtaaagcttgtgcaagagatctttgctcctgtcatttcacctatagaccctcgtttttttataagattgcacgaatcggctctatggagagacgatgttgccgaaacagataaacatatctttttcaatgatcccacttatacagacaaggaatactactccgactacccgacaattcatcatttgatcgtcgatcttatggagagctctgaaaagcatgacccccgacttgtctatttggctgtagcttggttagttgctcatagaggtcatttcttgaatgaagtagataaagacaatataggtgatgtactttcttttgatgctttctacccggaatttttggcctttttgtcagacaatggcgtcagtccctgggtctgtgagtcgaaggcccttcaagctactctgctgtctaggaatagcgtcaacgacaaatataaagcattaaaatcgctgatattcggatcgcaaaaaccggaagataactttgacgctaacatctctgaagatggtttaatccaattgctggcgggtaagaaagttaaagtaaacaaactattcccacaagagtccaacgatgctagctttacgttgaatgataaagaagacgctattgaagaaattctaggtactttaacgcctgacgagtgcgaatggatcgctcatattcgcagattgttcgattgggccatcatgaaacacgcgctaaaggatggcaggacgatatctgaatcaaaagtgaagctatacgagcagcatcatcatgacttgactcagttaaagtactttgtgaagacctacctagctaaagagtatgatgatatcttcagaaacgtagactccgagacaactaaaaattatgtagcttattcttaccatgtgaaggaagtgaaaggcacattaccaaaaaataaagcaacgcaagaagaattttgtaaatacgtccttggcaaagtcaaaaacattgaatgttccgaagcagacaaggttgattttgatgaaatgatacaacgacttacggacaattcttttatgccaaagcaagtctcaggtgaaaatagagtaataccataccagttgtactactatgaattaaagacaattttaaacaaagccgcctcatatctaccttttttgacacaatgcggtaaagatgctatttctaaccaagacaaattactgtctataatgacatttcgcataccatatttcgtcggccctttaaggaaagataattcagaacatgcctggttggaacgtaaagcgggtaaaatttacccgtggaactttaatgataaagtagatcttgataaatcggaggaagcctttatccgtaggatgaccaatacttgcacgtattacccaggagaagacgtgttaccattagattcacttatctatgaaaagtttatgatcttgaatgagataaacaatattaggattgacggataccccatttctgttgatgtgaaacaacaagtatttggtttatttgagaagaaaaggcgagtaacagttaaggatattcaaaatctactattatctcttggagcgttggataaacacggtaagctgactggtattgacacgacaatacactctaattataacacttatcatcattttaaatctcttatggagcggggagtattgaccagagatgatgtggaaagaatagtggaaagaatgacatattctgacgatactaagagggtcagactgtggttaaataataattatggaactctaacagctgacgatgttaagcatatctcaagactcagaaaacacgatttcggccgtttgtctaaaatgtttttgacaggattgaaaggtgttcataaggagacaggcgagagagcaagtatactggattttatgtggaatactaacgacaatttaatgcaactactgtccgaatgttacacattctcggatgagatcaccaaattacaagaggcctactacgcaaaagctcaattatcgctaaatgacttcttggactctatgtatatatcaaacgccgttaagagacctatttatcggaccttagcggtagtaaatgatattagaaaggcatgcgggacggcacctaaaagaattttcatcgagatggcgcgagatggagagtctaagaagaaaagatctgtgactcgtagagagcaaattaaaaatctctatagatcaattcgtaaagactttcaacaagaagttgattttctggaaaagatattggaaaataagagtgacgggcagcttcagtctgacgctttatatttgtattttgctcaattaggcagagacatgtacacaggtgatccaatcaaattagaacatattaaagaccaatctttttacaacattgatcatatttatcctcaatcgatggtgaaagatgacagtttggataacaaggtactagtccaaagcgaaatcaatggcgaaaagagttcgcgctatccattagacgcagccattagaaacaaaatgaagccgttgtgggatgcctactataatcatggattaatttctcttaagaaataccagcgtttgacgagatctactccatttacggacgacgagaagtgggattttatcaatcgtcagctagttgaaactaggcaatctactaaagctttagcaatattgttaaagcgtaagtttccagatactgaaatagtttactcaaaggctggactatccagcgattttagacatgaattcggcctggttaagagtaggaatattaatgatctacaccatgctaaagatgcctttctcgcaatagttactgggaacgtttatcatgaaagatttaatagaagatggtttatggttaaccagccatactctgtgaaaactaagacattgtttacccattcaattaagaatggcaactttgtcgcttggaatggagaagaagatcttggacgtatcgtaaagatgttgaaacaaaacaagaacacaatccacttcaccaggttttcctttgataggaaggagggattgttcgatattcaacctctcaaagcttctaccggattggttccacgaaaagcagggttggatgttgttaaatatggaggatacgataaaagcactgccgcgtattatttattagtacgttttacactcgaggataagaagactcaacacaaattgatgatgattcctgttgaaggtctctacaaagcacgtattgaccatgataaagagtttttaacagattatgctcagaccacgatcagcgaaattcttcaaaaggacaagcagaaagtgatcaacatcatgttccctatgggcacgagacatatcaaactgaattcgatgatttctattgatggattctatctttctattggtgggaagagtagcaaaggtaagtcagtactatgtcatgctatggtgccattaatcgtcccacacaagatagaatgttatatcaaggctatggaatcgtttgcaagaaaattcaaagaaaataataaattgaggatcgttgaaaagtttgataaaataactgttgaagataacttgaacttatacgagctttttctacaaaagttgcaacataacccatataataaatttttctctacacaatttgatgtgttgacgaacggtagaagtacattcaccaaattgtctccagaggagcaagtccagactttacttaatatactgagtatatttaaaacttgtcgttcttctgggtgtgatttaaaatcaataaatggttccgctcaagcggctagaattatgatatccgctgatttaactggcttatcaaaaaagtattcagatattagattagttgagcaaagcgcatcaggtctatttgtttcaaaatctcaaaatctcttggaatacttgccaaaaaagaaaaggaaagtttag

SEQ ID NO: 128 - DNA, 4005 bp, Artificial Sequence
  Description of Artificial Sequence: Synthetic polynucleotide
atgagtagtttaacaaagtttaccaataaatatagtaagcaactaactataaagaacgaattgataccggtcggtaagactttggaaaacataaaagaaaatgggttgattgatggagacgagcaattgaatgagaattatcaaaaagcaaagataatagtagatgattttttgagagactttattaataaagctctaaataacactcaaattggtaactggagagagctagccgacgccttgaacaaggaagatgaggataatattgagaaattacaagataagattagagggattatcgtgtctaagtttgagacttttgatctgttcagttcgtattcgattaaaaaggacgagaaaatcatcgatgatgataacgatgtggaagaagaggagctagaccttgggaagaagacatctagcttcaaatacatattcaagaaaaatttgttcaaacttgtccttccttcatatttaaaaacaacaaatcaagataagttaaaaatcatttcttccttcgataattttagtacttattttcgtggttttttcgaaaacaggaaaaatatattcactaaaaagcctatatctacctctatagcttatagaattgttcacgataatttcccaaaatttctagataatatcaggtgttttaatgtttggcaaaccgagtgtcctcagttaatagtcaaggccgacaactaccttaaaagcaagaatgtgattgcaaaagataagtctttggctaactattttacagtcggtgcctatgattattttctgagtcaaaatggtatcgatttctataacaacattattggcggcttaccagcttttgccgggcatgagaagattcagggtttgaacgaatttatcaatcaagaatgtcaaaaggattctgaattaaagtctaagctcaagaataggcacgctttcaaaatggcagtcttattcaaacaaatcctttcagacagagaaaagtcatttgtgattgacgagttcgaatcagacgctcaggtaattgatgctgttaaaaatttttacgcggaacaatgcaaagataataacgtcatatttaatttattgaatctgatcaagaatattgcttttttgtcggatgatgagttagacggcattttcatagagggtaaatacctgtcctctgtgtctcaaaaattgtatagtgattggtcaaagttgagaaatgatattgaagattcggctaattctaaacagggtaacaaagaattagcgaagaaaatcaaaactaacaagggtgatgttgaaaaggctataagtaagtacgagttcagtttatctgaactaaattcaattgttcatgataacacaaaattttccgatcttttatcatgcacattacataaagttgcaagtgaaaaattagtcaaagtaaacgaaggtgattggccaaaacatctaaaaaacaacgaggaaaaacagaagataaaagaacctcttgacgctttattggaaatatacaatactctattaatatttaactgtaaaagttttaacaaaaatggtaatttctatgtcgactacgatcgctgcattaatgagttgtccagtgttgtgtacttgtataataaaactcgtaattattgtacgaaaaagccgtacaacactgacaaatttaagttgaatttcaactccccacaactgggtgagggcttctctaaaagtaaagagaatgattgccttacattattatttaaaaaagatgataattattatgtcggaatcataagaaagggggcaaagatcaacttcgatgacactcaggccatagcagacaacacagataactgtatattcaaaatgaattattttttgctgaaggatgctaaaaaatttatccccaaatgttcaatacaattaaaagaggttaaggcccatttcaaaaagtcggaagatgactatattttgtccgataaggaaaaattcgctagtccgcttgttattaaaaaatccacatttcttctcgctacggctcatgtgaaaggaaagaagggcaatattaagaaatttcagaaagaatactccaaagaaaatcctacggagtatagaaatagtctgaacgaatggatagcattctgcaaagagttcttgaagacctataaagctgccaccatctttgatattacaactttgaaaaaggccgaggaatacgctgacattgtggaattctataaggatgtagataatctttgttacaagttagaattttgccctatcaaaacttcttttatcgaaaatcttatagataatggcgatttatacctgtttagaattaataacaaggacttttcttcaaaaagtacaggcacgaaaaacttacacacattatacttgcaggctatatttgacgagcgaaacttaaacaaccccacgataatgttgaatggaggtgcagagttattctacagaaaagaatctatagaacagaaaaatcggatcacgcacaaagccggtagtatcttagtgaataaagtgtgcaaagatggtacaagtctagatgacaaaatccgtaacgaaatttaccagtatgaaaacaaattcattgatactctttcggacgaagctaaaaaggttctgccaaacgttattaagaaagaggctacgcatgatataacaaaagataaacgtttcactagcgacaaattcttctttcattgtcctttaacaatcaactacaaggaaggtgacaccaaacaatttaataatgaagtgctctcattccttagaggtaaccccgatatcaatattatcggcattgatagaggagaaagaaacctaatctatgtaacagtcattaaccaaaaaggcgaaatattggatagcgtctccttcaatactgtcaccaataagtcatcgaagatagaacaaactgttgattacgaagaaaaattggccgttagagaaaaggaacgtatcgaagcgaagagatcttgggatagcatatccaagattgccaccttgaaggagggttatctaagcgcgatcgtacatgaaatctgcttattaatgattaagcataatgctattgtcgtgttagaaaacctgaatgccggttttaaaaggattagaggtggtttgtcagaaaagtcagtatatcaaaagtttgaaaagatgcttattaataaactcaactacttcgttagcaagaaagaaagtgattggaataaaccgtcaggtttgctcaatggtcttcagttaagtgatcaatttgagtctttcgaaaaattaggaattcaaagtggattcattttttatgtaccagccgcgtacacttcaaaaattgaccctacgaccggatttgccaacgtcttgaatttgtccaaggtcagaaatgttgacgccatcaaaagtttttttagcaacttcaatgaaatctcttattccaaaaaggaagcccttttcaagttttcttttgacctagactcgttatcgaagaaaggattttcatctttcgtaaagtttagcaagtccaagtggaatgtatacacattcggcgagagaattatcaagcccaagaacaaacagggctatagagaagacaagagaatcaacttgacttttgagatgaaaaaattactcaacgaatacaaggtttcatttgatttggagaacaacttgattcccaatttgacatcagctaacttgaaggatacgttctggaaggagttattctttatattcaaaacgacattacaactgcgtaatagtgttacaaacggtaaagaagatgtattaatctcacctgtaaagaatgccaaaggagaatttttcgtatccggtactcacaataagacactaccacaggattgcgacgctaacggtgcgtatcatattgcgttgaaaggattaatgatacttgaaagaaataaccttgttcgcgaagaaaaagacaccaagaagatcatggctattagcaatgttgattggtttgaatacgtgcaaaagaggagaggtgttttgtaa

SEQ ID NO: 129 - DNA, 3717 bp, Artificial Sequence
  Description of Artificial Sequence: Synthetic polynucleotide
atgaacaattatgacgagttcacaaagctataccctatccaaaaaactatcaggttcgaattgaaaccacaagggagaacaatggaacatctggagacattcaacttttttgaagaggacagagacagagcggagaaatacaaaattttaaaagaggccatcgatgaatatcacaaaaagtttatcgacgagcatttaacaaacatgtctttggactggaattcacttaaacaaatttctgagaaatattataagtctcgggaggaaaaagacaaaaaggtctttttgtccgagcaaaagagaatgagacaagaaattgtctcggagtttaaaaaagatgatcggttcaaagatttgtttagcaagaaattgttttctgaattgttgaaggaggagatatacaagaaaggcaaccatcaagaaatagatgctttgaaatcgtttgacaagttcagcggttacttcattggtttacatgaaaataggaagaacatgtatagcgacggcgatgagatcaccgctatatcgaatagaatcgttaacgaaaattttccgaaatttttggataatttgcaaaaataccaggaagctaggaaaaagtaccctgaatggataataaaggcggaatcagctttggtggctcacaacataaagatggatgaagtcttctcgctggaatattttaacaaagtattaaatcaggaaggaatccaaagatacaacttagccttgggtggatacgtaaccaaatcaggtgagaaaatgatgggcttaaatgatgcacttaatctagctcaccaatccgaaaagtcctctaaagggaggatacacatgacaccattgtttaagcaaatcctttcggagaaagaatctttttcatatatccccgatgttttcactgaggatagtcaattgttgcccagcattggtggattttttgcacaaatagaaaatgataaagatggtaacatcttcgatagagccttggaattgataagctcctatgcagaatacgatacggaacgaatatacattagacaagctgacatcaacagagtaagcaatgttatttttggtgagtggggaactttaggtggattaatgcgggagtacaaagctgactcaatcaatgatattaatttggaacgtacgtgcaaaaaagtcgataagtggcttgatagtaaggagtttgctctgtcggatgtactagaagcaattaagagaacaggaaacaatgatgcatttaatgaatatattagtaaaatgaggacggctagagaaaagatagacgccgcacgtaaggaaatgaagtttatttccgagaaaatatctggcgatgaagagtcgattcacatcatcaagaccctactcgattctgttcagcaatttctccatttttttaacctcttcaaagcaagacaagacattcccttagatggggctttttatgccgaatttgatgaagttcattcaaagttgtttgctattgttcctctttacaataaggtccgtaattaccttactaaaaataacttgaacaccaagaaaataaagttaaacttcaagaatccgactcttgccaacgggtgggatcagaataaagtttatgattatgctagcttaatatttctaagagatgggaattattacttaggaatcatcaatccaaagcgtaagaaaaacattaaatttgaacaagggtcaggcaatggcccattctatagaaaaatggtgtataagcaaataccaggacctaacaagaacttgcctcgcgtatttttaacttcaacaaagggtaaaaaagaatataaaccaagcaaagaaattattgaaggttacgaagcagataaacacatcagaggtgataagttcgatctggatttctgccataaattgattgacttttttaaggaatctatagaaaaacataaggactggtccaaatttaatttctacttctcacctacagaaagttatggtgacatttcagaattttatttagacgttgagaaacaaggatataggatgcattttgaaaatatttcagcggaaaccatcgacgaatacgttgagaagggtgatttattcttgttccaaatttacaataaagacttcgttaaagctgcaaccggaaagaaggatatgcataccatatattggaacgctgcattctcgccagaaaacttacaagatgtcgttgtaaagcttaatggagaagctgagctgttctatagagacaagagtgatataaaagagattgtgcatcgggaaggtgaaattctggtgaacagaacttacaatggtcgtacacccgttccagacaaaatacataaaaaactgaccgattatcataatggtaggacaaaggacttgggcgaggccaaggagtacctcgataaagttagatatttcaaggcacactatgatattacgaaagacaggagatatttaaacgataaaatttactttcatgtccctttgacccttaactttaaagctaatggtaaaaagaatttgaacaaaatggtaattgagaagtttttatcggacgaaaaagctcacataatcggaatcgaccgcggagagagaaatttactgtattatagtatcatcgacagaagtggaaagattattgatcagcaatctttgaacgtcattgatgggtttgactatcgggaaaagttaaatcaaagggaaattgaaatgaaggatgcgagacaatcatggaatgccattggtaaaattaaagatctcaaggaggggtacttatcaaaagctgtacacgagataactaaaatggctatccaatataatgcaattgttgtaatggaagaattgaattatggttttaaacgcggcaggtttaaagtcgaaaaacaaatataccaaaagtttgaaaacatgttaattgataagatgaactatcttgttttcaaagatgcacctgatgagagtcctggcggtgtgctgaacgcctatcaattaacaaacccattagagtcctttgctaaactgggtaaacaaactggcattctattttatgttccagccgcttacacctcaaagatcgatccaacgaccggttttgtaaacttatttaatacttcttccaaaacaaacgcgcaagaacgcaaagaattcctacaaaaatttgaatcaatatcctatagcgcaaaagatggaggtatattcgctttcgcttttgactacagaaagtttggcacttccaagacagatcataaaaatgtgtggaccgcttataccaacggagaaaggatgcgttatattaaagaaaaaaagaggaacgaactatttgatccatcgaaagaaattaaagaagctttgacaagcagcggaatcaaatatgatggaggtcaaaacatacttccagatattctcagatctaataataacggtcttatttacacgatgtattcatcttttatcgctgccatccaaatgcgtgtgtatgatggcaaggaagattatattatatctcctattaaaaattcaaagggtgaattttttcgcacggatccaaaaagaagagagcttccaattgacgccgatgctaacggtgcttacaatattgcattgcgtggtgaacttactatgagagccatcgccgaaaagtttgatccggacagtgaaaaaatggcgaaattggagctaaagcacaaggattggtttgaattcatgcagacccgtggcgattga

SEQ ID NO: 130 - DNA, 3897 bp, Artificial Sequence
  Description of Artificial Sequence: Synthetic polynucleotide
atgactaaaacgttcgactccgagttttttaatctctattccttgcaaaagaccgttaggtttgaattgaaaccagttggtgaaactgcctcatttgtcgaagactttaaaaacgagggattgaaaagagtggttagtgaagatgaaagaagggcagtagactatcaaaaggttaaagaaatcattgacgattaccacagagattttatagaagaatctctgaactattttccagagcaggtttcaaaagatgctctagagcaagcgtttcatttgtatcaaaagttgaaagcagcgaaggtggaagaaagggaaaaagctttaaaagaatgggaagcattacagaaaaaattgcgagaaaaagtcgtcaaatgtttcagcgactctaataaagctcgcttttctagaatcgataaaaaagaattgattaaggaagatttaataaattggctggtagcacaaaacagagaggatgatattcctactgttgaaacgttcaataattttactacttacttcactggtttccatgagaacaggaagaatatttactctaaagatgatcacgctactgctataagttttaggttgattcacgaaaacttgcctaaattttttgacaatgtcatcagttttaacaagttgaaagaaggtttcccggaattaaaattcgacaaagttaaagaagatttagaagtagattacgacttgaagcatgcgtttgaaattgaatatttcgttaatttcgtcacacaagctggtatcgaccaatataattacctgcttggaggcaaaactctagaagacggtacgaagaaacaaggaatgaatgaacagattaatttatttaagcaacaacaaactcgcgataaagctagacagattccaaaactgattccacttttcaaacagattctatctgagagaactgaatctcagagttttatccctaagcagttcgagtctgatcaggaactattcgattccctgcagaaattgcataacaactgtcaagataagtttaccgttttgcaacaggcgatcttgggattggctgaggcagatcttaaaaaggtctttattaaaactagtgatctaaacgcattgtctaacactatttttggaaattattctgtgttctcagacgcgctcaatttatataaagagtcgctaaaaactaaaaaggctcaagaagcttttgaaaagttgcctgcacatagtattcatgatttaatccaatacttagaacaatttaattcgtctctcgatgctgaaaagcaacagtctaccgatactgtattaaactactttattaaaaccgacgaattatatagtcgtttcattaaatccacctctgaggcattcacccaagtacaacctctctttgaactggaagctttgagctccaaaagaagacccccagaaagtgaagatgagggggctaaaggccaagaaggtttcgaacaaattaagagaatcaaagcttatctagacactctaatggaggctgtccactttgctaagcctttgtatcttgtcaagggtagaaagatgatagagggtctagacaaggatcaaagcttctacgaagcgtttgaaatggcctaccaggagttggagtctttaatcatccccatttacaataaggccagatcttacctgtctaggaagccatttaaagcggataaattcaaaattaattttgacaataatacacttctatctgggtgggatgctaacaaggagacggctaacgccagcatattgtttaagaaggatggtttatactacctgggaatcatgccaaaaggcaaaactttcttgttcgattatttcgttagttcagaagattctgaaaagttgaaacaacggagacagaaaaccgcagaggaagcgctcgcacaggatggagaatcctattttgaaaaaatacggtataaactcctaccaggtgctagtaagatgttgccaaaggtattttttagcaataaaaatattgggttttacaatccctcagatgatattctacgaattcggaatacggcctctcatactaagaatggtactccccagaagggtcattccaaggtagaatttaacttgaatgactgtcacaaaatgattgatttttttaaatcttccatacagaaacatcccgagtggggatcctttggtttcactttttctgatacgtcggactttgaagatatgagtgctttctaccgagaagttgaaaatcaaggttacgttataagttttgataaaataaaagaaacttacattcagtctcaagttgagcaaggtaacttatatttatttcaaatttacaacaaagattttagtccgtattcaaagggaaagccaaacctgcacactttatactggaaagctctgtttgaagaggctaatttgaataacgtagtggctaagctaaacggcgaagcagaaatctttttcagaagacacagtatcaaagcatctgataaagtggtacatcctgctaatcaagctatagataataagaatccccatactgagaagacgcagtccacatttgaatatgacttggtcaaagacaaaagatatacccaagacaaatttttttttcatgtaccgatatctttaaactttaaggctcagggcgtttcaaagtttaatgataaggtaaatggattcttaaagggcaatcccgacgttaatataatcggtatagatcgaggtgagagacatcttttatactttaccgtggtgaatcaaaaaggagaaatattagtgcaagagtccttgaatacattaatgtctgacaagggtcatgtcaacgattatcaacagaaattggacaagaaggaacaggaaagggacgctgccaggaagtcctggacgacagtagaaaatattaaagaattaaaagaaggttatttatcacatgtggttcataaacttgcacatttaatcatcaaatataacgcaatagtgtgcttggaagatcttaattttggcttcaagaggggtaggttcaaggtcgaaaaacaggtctaccagaagttcgagaaagctctgatcgataaattgaattatcttgttttcaaagaaaaagaattaggagaagttggtcattatcttacagcataccaactcactgcaccatttgaaagcttcaaaaagctaggcaagcaatctgggattttgttctatgttccggctgattatacatcaaagatagatcctaccacaggctttgtaaattttttagatcttaggtaccaatccgttgaaaaagctaaacagttgctgtccgattttaatgcgataagatttaatagtgttcagaattattttgagttcgaaattgattataaaaaattgacaccaaaacgtaaagtaggaacacaatctaaatgggttatttgtacctatggagatgttagataccaaaacagaagaaatcagaaaggtcactgggaaactgaagaagttaacgttactgaaaaacttaaagctctatttgcgagcgattcaaaaacgacgacggtgatcgattatgcaaatgatgataaccttattgatgtaattctggaacaagataaggcatcattttttaaagaactactatggttgttaaagctaaccatgaccctaaggcactccaagataaagtcagaggatgattttatcctctctccagtgaaaaacgaacaaggtgagttttacgactcaagaaaggcgggtgaagtctggcctaaggatgctgatgccaatggagcttatcacatcgctctgaaggggctatggaacttacagcaaattaaccaatgggaaaaaggtaaaactttaaacctcgccataaagaaccaggattggttcagctttatccaagaaaaaccatatcaagaataa

SEQ ID NO: 131 - DNA, 3708 bp, Artificial Sequence
  Description of Artificial Sequence: Synthetic polynucleotide
atgcacacaggaggtctactctcgatggatgctaaggaatttaccggtcaatatccgctgtccaaaactttgcgttttgagcttagacctattggccgaacgtgggataacctagaggcttctggttatttggcggaagatagacatagagctgagtgttatccccgagctaaagaattgctggatgataaccacagggcgttcctgaatagagttctaccgcaaatcgatatggattggcatccaattgctgaagctttctgcaaggtgcacaaaaatccaggtaataaagaattggctcaggattataatttgcagcttagtaagagaagaaaagaaatttccgcttatttgcaggatgctgatggatacaaggggttgttcgcgaaacctgccctggacgaagctatgaaaatagctaaggaaaacggcaatgaatctgatattgaagttttggaagccttcaatggattttccgtttatttcactggttatcatgagagtagggagaatatatactcagacgaagatatggtatccgtcgcctatcgcataactgaagataattttccaaggttcgtgtcgaacgcgttaatttttgataaactaaatgaatcgcacccggatattatttcggaagtgtccggtaatctgggggtagacgatattggtaaatattttgatgtgtccaactacaataatttccttagtcaagcaggaattgatgactacaaccatattataggagggcatacaactgaagacggtctcattcaagcttttaacgtagtgttaaacctaaggcaccaaaaagacccaggttttgagaaaattcaatttaagcaactctacaagcagatactgagcgttaggactagtaagtcatatatcccaaagcaattcgataactcaaaggaaatggtcgactgtatatgcgactacgtctcaaaaatagaaaaatctgaaacagtagaaagagctctgaaattggtaagaaatatatcttcttttgatttaagaggtattttcgtaaataaaaaaaaccttcgaattttgtctaataagttaattggagactgggacgcaatagagacagctttgatgcacagttccagcagtgaaaacgataagaaatcagtgtatgactctgcagaggcattcacccttgatgatatcttcagttctgtgaaaaagttcagcgacgcctccgctgaggatataggaaaccgcgctgaagacatatgtcgtgttatctcagaaacagctcctttcattaacgacttaagggctgtagatttggattctttaaatgatgacggctatgaagcggccgtgtctaaaatacgggaatctcttgaaccctacatggatctatttcacgaattggagatctttagcgtgggtgatgagtttcctaaatgtgctgccttttatagcgagttggaagaggtctcagaacaactgattgaaatcattcctttatttaacaaagcaagaagtttttgcacaaggaaaaggtattcaaccgacaaaatcaaagtcaatttaaaattccctactctggcagatggatgggatctaaataaagaaagggataacaaagccgcaattctaagaaaagacggtaaatactacctggcaattttagacatgaagaaagatctcagtagtattcgtacgagcgatgaggacgagtcttcttttgaaaagatggaatataaattgctcccttctcctgtgaaaatgcttccaaaaatttttgttaaatcgaaagccgccaaagaaaagtacgggttgaccgatagaatgttagaatgctacgataaaggtatgcataagtcgggtagtgcttttgatttgggtttttgtcatgaattgatcgattactataagcgctgcattgccgagtacccaggctgggatgttttcgactttaaatttcgtgagacaagcgattacggatccatgaaagaatttaatgaagacgtcgctggcgcaggttactatatgtcacttagaaagattccatgttccgaagtttatcgtttactggacgagaagtcaatttacttgtttcaaatatataataaggattatagcgaaaacgcacatgggaataagaatatgcatacgatgtattgggagggcttgttctcaccacaaaatttggaatcaccagtcttcaaattgtccggaggcgcagaactttttttcagaaagtcatctattcctaatgacgctaaaacggtacatccgaaaggttcagttcttgttcccagaaacgacgtcaatggtagaagaataccagactcgatctacagagagttgacaaggtattttaaccgtggggattgcaggatcagtgatgaagctaagtcttacctggacaaggtcaagacaaaaaaagcggaccatgacattgttaaggatagaagatttactgtagataagatgatgttccatgttccgattgccatgaattttaaagctataagtaaaccaaatcttaataagaaagttattgatggcataatagatgatcaagatttgaaaatcatcggtatcgatcgtggtgagagaaatcttatttatgtgaccatggtcgataggaaggggaatatattgtatcaagacagtcttaatattttaaatggatacgattaccgcaaagctttagacgtgagggaatatgataacaaagaagctagaaggaattggactaaagtagaaggtattagaaaaatgaaagaaggttatttatctttagctgttagtaaattggccgatatgatcatcgaaaataatgctataatcgtaatggaagatttgaatcacgggtttaaggcaggtcgttccaaaattgaaaagcaggtgtatcaaaaattcgaatcaatgttaatcaacaagttaggatacatggtgctaaaagacaagtccattgaccagtctggtggagcccttcatggttaccaattagccaatcatgttacgaccttagctagcgtgggtaaacaatgtggagtaattttttacatacctgcagcttttacttcgaagattgatcccaccacgggctttgctgatttattcgctctctctaatgtgaagaatgtcgcttctatgagagagttcttctccaaaatgaagtcagtaatatatgacaaggcggaaggcaaattcgcctttacatttgattatttggattataacgttaaaagcgaatgtggacgtaccttatggactgtgtatacagttggtgaacgcttcacctactctagagtaaaccgagagtatgttcggaaagtcccaacagatatcatctatgatgcattacaaaaagctggtattagcgtcgaaggtgaccttagagatagaatcgcggaaagcgacggtgacacattaaagtctatattctacgcttttaaatacgcgttggatatgagagtcgaaaacagagaggaagactatatacagtcacctgtgaagaatgcttctggtgagttcttttgttcaaaaaacgccggaaagtctttgccgcaggattcagatgcaaatggtgcctataatatagctctgaaagggatcctacaactcagaatgttgagcgaacaatacgatccaaatgcagaatcgattagattgccacttataactaacaaggcatggttaacttttatgcaatccggtatgaaaacttggaagaattaa

SEQ ID NO: 132 - DNA, 3783 bp, Artificial Sequence
  Description of Artificial Sequence: Synthetic polynucleotide
atggattctcttaaggatttcactaatttatatccagtctcgaaaacattgcggttcgaattgaaaccagttgggaaaactctagaaaacattgaaaaagccggtatattgaaagaagatgaacacagagcggaatcctaccgccgggtaaaaaagataattgacacataccataaagtgtttattgacagctccttagagaacatggctaaaatggggatagaaaatgaaatcaaggctatgctgcagtctttttgtgaactctataagaaagaccacaggacagaaggagaagataaagctcttgataaaattagagctgttcttagaggtttaatcgttggggctttcactggtgtatgtggaagacgagaaaacacagtacaaaatgaaaagtacgagagtttgttcaaagaaaaattgataaaggaaattttgccagatttcgtgttgtccaccgaggctgagtctcttccattcagcgttgaagaagcaacaaggagcttaaaagagtttgactcattcacttcttattttgctggtttttacgaaaatagaaagaatatttattccacgaaaccgcaaagtactgcgatagcctacagattaattcatgaaaacttgcctaaatttatagataatattttggtcttccagaagattaaagaaccaatcgctaaagaacttgagcacataagagcagattttagcgcaggcggatatatcaaaaaagatgaacggctagaagacatattctcattaaattactacattcatgtcctttctcaagctggtatagaaaaatataatgctttaatcgggaagatagtgacggaaggtgatggtgaaatgaaaggtcttaatgaacatattaacttatataaccaacagaggggtcgagaggataggttgcccttgtttaggcctctatacaagcaaatcctgtccgatagagagcaattgtcttatttacctgaatcatttgaaaaagatgaagagctgcttagagcacttaaggaattttacgatcacatcgccgaagacatcttgggtagaacacagcaattgatgacttcaatttctgaatacgacttgtcccgtatttatgtcagaaatgattctcaacttacagacatctcgaagaaaatgctaggagattggaacgccatttatatggctagagaacgagcctacgaccacgaacaggctcctaaacgtattactgctaaatacgaacgtgatagaatcaaggccttaaaaggtgaagagtcaatttcattggcgaatctgaacagctgtatagctttcttggacaatgtaagggattgtcgagttgacacatacctatcaactttggggcagaaagagggtcctcatggcttaagtaacttggtggaaaacgtcttcgcctcatatcatgaagcagaacagttattgtcgtttccttaccccgaagagaacaaccttattcaggacaaagacaatgtagttttgatcaaaaacctattggataatataagtgatttacaacgtttccttaaacctttgtggggaatgggcgatgaacctgacaaagacgaaaggttttacggtgaatacaactatattagaggagcgcttgaccaggtaatacctttgtacaataaagtaaggaactacttgactcgtaaaccatattctactagaaaagttaaattgaactttggtaattcacagctgctgagtggttgggatcgtaataaagaaaaagataactcctgtgttatcttgcgaaaaggacaaaacttttacttggcaattatgaacaaccgtcacaaaaggtccttcgagaacaaagttctgcctgaatacaaagaaggtgaaccatattttgaaaaaatggactataaattcctgccagatcctaataaaatgttgcctaaggtcttcttgtctaaaaaaggtatagaaatatataaaccatccccgaagttgctggagcaatatggtcatggaacgcacaaaaaaggtgacacttttagtatggatgacttgcacgagttgattgatttttttaaacattccattgaagcgcacgaagattggaaacaatttggtttcaagttctctgacacagccacttacgaaaatgtatcgtccttttatagagaagtggaagatcagggttataaactgtcattccgtaaggttagtgaaagctatgtgtactcgttgatcgatcaagggaagctttatctttttcaaatctataataaagatttctctccttgttcaaagggcacacctaatcttcatacactatactggagaatgcttttcgatgaaagaaatttggctgatgtgatctataaattagacggtaaagctgagatttttttcagagagaaatccctgaaaaacgaccatccaactcatccggcaggtaaaccgattaaaaagaaatcccggcaaaaaaagggcgaagagagtttattcgagtatgatttagttaaggacagacattatacaatggacaaatttcaatttcatgtgcccattactatgaactttaagtgtagtgcagggtctaaggttaatgatatggtaaacgcacatattagagaagctaaagatatgcacgtcatcggtattgatcgcggagaaagaaatttactttacatttgcgttatcgattctaggggcaccatcttggatcaaatctctttgaacactataaatgatattgactatcatgatctactagagagtcgggataaagacaggcaacaagaaagaagaaattggcaaacaattgaaggtattaaagaattaaagcaaggctatctaagccaggctgtacacagaattgccgaattaatggtagcatataaagctgtcgtagctctagaagacttgaacatgggtttcaaaagagggcgccagaaggtcgaaagtagtgtttatcaacaatttgaaaaacagttaatagataagttgaattatctagtggataaaaaaaagcgtcctgaggacattggcggtttattaagagcctaccaattcactgcgccatttaaatcgttcaaagaaatgggtaaacaaaacggttttctattctacatccccgcatggaatacctcaaatatagatccaactaccggtttcgtcaacttatttcatgctcaatatgagaatgtggacaaagcaaaatcattctttcaaaaatttgatagcattagctacaatcctaaaaaagattggtttgaatttgcgttcgattataaaaatttcaccaagaaggctgaaggttccagatctatgtggatattgtgcacccacggaagtagaattaagaacttccgtaattcacagaaaaacggccagtgggacagcgaagaattcgccctaaccgaagctttcaaaagtcttttcgtaagatacgagatagactatacagctgatctaaagacagctattgtggatgagaagcaaaaagacttctttgtcgaccttcttaagttgttcaagttaactgtgcagatgagaaatagttggaaggaaaaagacctagattacttgattagcccagtcgctggtgcagatggcagattttttgatacacgtgaaggcaataaatcactaccaaaagacgcggacgctaatggcgcatacaacatcgcattgaagggtttgtgggctctcaggcagattaggcagacaagtgagggtggtaagcttaagctggcgatttctaataaggaatggttacagtttgttcaagaaagatcctacgaaaaagattaa

SEQ ID NO: 133 - DNA, 3792 bp, Artificial Sequence
  Description of Artificial Sequence: Synthetic polynucleotide
atgaacaatggtactaataattttcaaaacttcatagggatttctagccttcaaaagacattgagaaatgctttaattccaacagaaacgactcaacaattcatagtgaaaaatggtattataaaagaagacgagttgcgtggcgagaatagacaaattttgaaagatatcatggatgactactacagagggttcatctccgaaacattgtcttctattgacgacattgactggaccagcttattcgaaaaaatggaaatacagctgaagaacggagataacaaggacactcttataaaggagcaaacggaatatagaaaggctatacacaaaaagtttgctaatgacgatagatttaaaaacatgtttagtgcgaagttaatttctgatattctacccgagtttgtcattcataataataactactctgcatctgaaaaagaggagaagacccaggttataaagttgttttcaagatttgccacatcatttaaagactacttcaagaacagggcgaattgcttctctgctgatgatattagctcttccagctgtcatagaattgttaacgataatgccgaaattttttttagtaatgccttggtatatagacgcatagtcaagtcactaagcaatgatgatataaacaagattagtggtgatatgaaagatagccttaaagaaatgagccttgaagagatatattcatatgagaagtacggtgaatttataactcaagaaggaatttctttttataacgatatttgtggtaaggttaattcttttatgaatttgtattgccagaagaacaaggaaaataagaatctatataaactacaaaagttgcataaacagattttgtgtatagctgatacatcctacgaagttccgtataaatttgaatctgatgaggaagtttatcaatcggtaaacggttttcttgacaacatttccagcaaacatatcgttgagagactacgtaaaattggagacaactataatggttacaatctagataaaatatacatagtgtccaagttttatgagtctgtctctcaaaagacatatcgtgattgggagaccattaatactgcacttgaaattcattataacaacatattgcctggtaacgggaagagtaaagctgataaggttaaaaaggccgtcaaaaacgacttgcaaaagtctattaccgagataaatgaattagtgtcaaactacaaactatgctcagatgataatattaaagcggaaacatacatccacgaaatttcccacatactgaataactttgaagctcaggagcttaaatataacccggaaatacacttggttgagagcgagttaaaagcatctgagttgaaaaatgtattagacgtcatcatgaatgcgtttcattggtgttcagttttcatgactgaagaattagtcgacaaagataacaatttttatgccgaattagaggaaatatatgatgaaatttatcccgtaattagtttatacaatctagttagaaattatgttacacaaaagccgtatagtaccaagaaaataaagcttaatttcggaatacctacgcttgctgatggttggtcaaaaagtaaagaatatagcaataatgcaataattttaatgagagataacctatattatttgggtatttttaacgctaagaacaaaccagacaagaaaataattgaaggtaatacatctgaaaacaagggcgactataaaaagatgatatacaatttgctcccaggtcctaataaaatgattcctaaggttttcctgagtagcaagactggcgttgaaacttacaagcctagtgcgtatatcctggagggttataaacagaacaagcatatcaaatcctctaaggacttcgatatcaccttttgccatgacttaatcgattattttaaaaattgtatcgcaattcatccagaatggaaaaatttcggatttgattttagtgataccagcacttacgaggatatctctgggttctacagagaagtggagttgcagggctacaaaatcgattggacttacatatctgaaaaggacatagatttgctgcaggagaaaggtcagctatatttgtttcaaatctacaacaaagacttttctaaaaagtctaccggtaatgacaatctgcacacaatgtacttgaagaacttattctccgaggagaacttaaaggacattgtactcaagttgaatggagaagccgagattttttttagaaagagcagtataaagaatcctataatccacaagaagggctcaattctcgtgaataggacgtatgaggcagaagaaaaggaccaatttgggaatatacaaattgtaagaaaaaacatcccagaaaatatctaccaggaattatataagtattttaatgacaaatctgataaggaactgtctgacgaagccgctaagctcaagaatgttgtgggccaccatgaagctgctactaatatagtgaaggactacagatatacctacgataaatatttcctgcatatgccaattactataaacttcaaagcaaataaaacaggttttataaatgatagaatcctgcagtatattgctaaagaaaaggatttacatgtaattgggattgatagaggtgaacgcaatctgatctatgtcagcgtaatagatacttgtggtaatattgtggaacaaaagtcctttaatattgtgaacggatatgattaccaaatcaagttgaaacaacaagagggagcacgccaaattgcccgtaaggaatggaaagagataggtaagatcaaggaaattaaggaaggttatctttcattagttattcacgaaatttcgaagatggtaatcaaatacaacgcaataattgctatggaggacctgtcatatggatttaagaaaggtagattcaaggttgagagacaggtataccagaaatttgaaactatgttgatcaacaaattaaattacttagtctttaaggacatatcaataacggaaaacggcgggcttttaaaagggtatcaacttacatacatacctgataagttgaaaaatgtgggtcatcagtgtgggtgcatcttttatgttccagccgcttacacatcaaaaatcgatcctactactgggttcgtaaacatatttaaatttaaagatctaaccgttgatgcaaaaagagagtttatcaagaaatttgatagcattaggtacgattcagaaaaaaatctattctgttttacttttgactacaacaactttataacgcagaatacagtgatgtcaaaatcgtcctggtcagtgtatacttatggtgttagaattaagagacgtttcgtaaacggtcgtttttctaacgagtccgatacaatcgacatcactaaagatatggaaaaaactttggaaatgacagatataaactggagagatggtcacgaccttagacaagatataatcgattatgaaatcgtacagcatatttttgaaatttttcgcttaacagttcagatgcgtaactctcttagtgagctagaagatagagattatgatagacttatctcgcctgttcttaacgaaaataatatcttctatgactcggcaaaagccggtgatgcacttccaaaagatgctgatgcaaatggcgcgtactgcatcgcattgaaggggctctacgagattaaacaaatcaccgaaaactggaaagaagatggtaaattttctagggataagttgaaaatcagtaataaagattggttcgattttatacaaaataagcgatacttatag

SEQ ID NO: 134 - DNA, 3957 bp, Artificial Sequence
  Description of Artificial Sequence: Synthetic polynucleotide
atgaccaataagtttactaatcaatactcattgtctaaaacgttaagattcgagttaattccccagggaaagacactagaatttattcaagaaaaaggtcttctctctcaggataaacaaagagcagaatcataccaggagatgaaaaaaaccatagataaatttcataagtacttcatcgacttggcactatcgaacgccaagctaacacatttggaaacctacctggagttgtataataaatcggcagagacgaaaaaggaacaaaaattcaaggatgacctgaagaaggttcaagataatctgcgaaaggaaatagtgaagtcgtttagtgatggtgatgcaaagtcaatctttgctattttagacaagaaggaattaataaccgtggaacttgaaaagtggtttgaaaataacgaacagaaagatatttacttcgacgaaaaatttaaaacgtttactacgtactttacagggttccatcagaaccgcaaaaacatgtactccgttgaaccaaactctactgcaatcgcctacagattaatacacgaaaatttgcctaagtttttagaaaatgcaaaggcttttgaaaagataaagcaagtcgaatcgttacaggtaaactttcgcgaattaatgggcgaatttggagatgaaggtcttatttttgtcaatgaattagaggaaatgtttcaaattaattattataacgatgtcttgagtcagaacggcattactatctacaactcaattatcagtggtttcactaagaatgatataaaatataaaggtttgaatgaatacattaataattataatcaaactaaagataagaaggacaggcttccgaaattgaagcaattgtacaagcagattctaagtgataggattagtttgtctttcttgccagacgcatttactgatggcaagcaagtcttaaaggctatattcgatttctacaagattaacctactttcgtacacaattgaaggtcaagaagaatctcaaaatctgctgcttttgattaggcaaactatagaaaatttgtcgtcctttgacactcaaaaaatttacctgaagaatgatacacacctgactacaatatcacagcaggtctttggggatttttctgtcttctccacggccctaaactattggtatgagacaaaagttaatccaaaatttgaaacagaatatagtaaggcgaatgaaaaaaagagagaaattttggataaagcgaaggcagtattcacaaaacaagactatttttctatcgcatttctccaagaagtcttatccgaatatattttgacactcgatcacacctctgatatagttaagaaacattcgtccaactgcatcgcagattacttcaagaatcacttcgtggctaagaaagaaaacgaaacggataaaacttttgacttcattgctaacataaccgctaaataccaatgtattcagggcatattagaaaatgcagaccagtacgaagacgagttaaaacaggaccaaaagttaatagataatctaaagtttttcttagatgctatacttgagttattacattttataaagccattgcatctaaaatcggaaagtattactgaaaaagacactgcgttctatgatgtgttcgaaaattattatgaggctttatctttattgacccccctttacaacatggtccgcaattatgttactcagaagccttactctactgaaaagatcaaattaaactttgaaaatgctcagttgctgaatggttgggatgccaataaggaaggtgactacctgacgactattctaaaaaaagacggtaattatttcttagcaatcatggataaaaaacataacaaggcatttcaaaaatttccagaaggaaaagaaaactatgaaaagatggtttataaattgttgcctggagttaataaaatgttgccaaaagttttttttagcaataagaacatagcttactttaatccatctaaggaactgctcgagaactacaagaaggaaacacataaaaaaggtgatacatttaatttggaacattgccatactctgattgatttttttaaggactctcttaataaacatgaagactggaaatattttgattttcaattttcggaaactaaatcataccaagatctaagtggattttacagagaagttgaacaccaaggttataagattaacttcaagaatatagattctgaatacattgatggtcttgtaaacgagggtaaactattcctgttccaaatctactctaaggacttctcacctttttccaaaggaaaacctaatatgcatacgttgtactggaaggctctatttgaagaacaaaatttgcaaaatgtaatctacaaactgaacggccaagctgaaatattcttcagaaaagcctcaattaagccaaaaaacattattcttcataaaaagaagatcaagattgcgaagaaacattttattgataagaagaccaagacttccgaaattgtaccagtacaaacaatcaagaatctcaatatgtattatcaaggcaagataagtgagaaagagttaacccaggatgatttacgttatatagacaatttctctatattcaacgagaagaacaaaacaatagacattatcaaagataaaaggtttactgttgacaaatttcaatttcatgtgcctatcacaatgaactttaaggccacaggtggttcgtacattaatcaaactgttttagaatatctgcaaaataacccagaggtcaagatcatcggtcttgataggggtgagagacatctggtgtatctaacactcattgatcaacaaggcaacatcttgaagcaagaatcattgaacactatcacagactccaagatctcgactccatatcacaaactccttgacaataaagaaaacgaaagggatcttgccagaaaaaattggggtacagttgaaaatattaaggaactaaaagaaggttacatttcgcaagtagttcacaagattgcaacactcatgttggaagaaaacgcaatcgttgtcatggaagatttaaatttcggatttaagagaggaagatttaaagtagaaaagcaaatctaccagaagttggagaagatgttaattgacaaattgaactacttagtgctgaaagacaaacagcctcaagaattgggcggtctatacaacgctttacaactgacaaataaatttgagtcattccaaaagatgggtaagcagagtggttttttgttttatgttccggcatggaacacatccaaaatcgatccaactacaggcttcgtgaattatttctacactaaatatgaaaatgtggataaagcaaaagctttctttgagaagttcgaggcgatccgttttaacgctgaaaagaagtacttcgagttcgaggtcaaaaagtattcagattttaaccccaaggctgaaggcacccagcaagcatggactatttgcacgtacggtgagcgaatcgaaactaaaaggcaaaaggatcaaaataataagtttgtaagcacacccattaacttgacagaaaagatagaagattttcttggaaaaaaccaaattgtatatggtgacggtaactgtatcaagtcacaaattgcttctaaagacgataaggccttcttcgaaactctgctatactggtttaaaatgacgttgcaaatgagaaacagtgaaactagaactgatatcgactatttaatatcacccgtgatgaacgataatggtaccttttacaattcaagagattacgagaaattggagaaccccacactaccaaaagacgcagacgctaatggtgcctaccatattgctaaaaagggactgatgttgttgaacaagatagatcaagccgacttaactaaaaaagttgatttgtcaatttcgaatagagattggttgcaattcgtccagaaaaataagtaa

SEQ ID NO: 135 - DNA, 4017 bp, Artificial Sequence
  Description of Artificial Sequence: Synthetic polynucleotide
atggaacaggaatactacttgggtttggatatgggaactggttcagtcggttgggctgttacggactccgagtaccacgtgttgagaaaacacggaaaggctttatggggtgtcagactattcgaatcagcatcgaccgcggaagagagaagaatgtttagaacttcaagaagaaggctggatcgtaggaattggcggatagaaattttacaagaaatattcgccgaagaaatctctaaaaaagatccaggattttttctacgtatgaaggaatccaaatactatccggaagataaacgtgatattaatggcaattgtccagagttaccctatgctttatttgtggacgacgatttcaccgataaagattaccataagaagttcccaacaatttaccatctgagaaagatgttaatgaacactgaagaaaccccggatataagactggtctatctagccattcatcatatgatgaaacacaggggacacttcttgctatcaggggatataaatgaaattaaagaatttggtacaacattttctaaattattggaaaatattaaaaacgaagaattagattggaatttagaattaggcaaggaggaatacgcagttgtcgaatcgattctgaaagataacatgttgaacagatcaacgaaaaaaacaaggctgatcaaggctttaaaagcgaaatcaatatgcgaaaaagcagtattgaatttgttagctggggggactgtcaagttgtctgatattttcggattggaagaattgaatgaaacagagagaccgaagatatccttcgccgataatggctacgatgattatataggcgaagtcgaaaatgagctgggcgaacaattctacattatcgagactgccaaggctgtttatgattgggcggtgttagtcgaaatccttggcaaatacacttccatctccgaagctaaggtggcaacctacgaaaagcataaaagtgatttgcaattccttaagaaaattgtccgaaagtacttgaccaaagaagagtacaaggatattttcgtatcaacatcggacaaactgaagaattattcagcttatattggcatgacgaaaattaatggtaagaaagttgatttgcaatccaagagatgttctaaagaagaattttacgatttcattaaaaaaaatgtcctaaaaaagttggagggacaacctgaatatgagtatttaaaggaagaactggaaagagaaactttcctaccaaagcaagttaatcgtgataatggcgttattccataccaaatacacttgtacgaattaaagaagatcttgggtaacttgagggacaaaattgatttaatcaaggaaaatgaagacaaactggtacaattatttgaatttagaataccttactacgtgggccctttaaacaaaatagacgatggtaaggaagggaagttcacatgggcagtcagaaagtccaatgaaaaaatttacccatggaatttcgaaaacgttgtagatattgaagcttctgctgagaaatttattaggagaatgacaaataaatgcacttatcttatgggggaagacgtgttgcctaaagatagtttattatattcaaagtatatggtcttaaatgaattaaacaatgttaaattagatggtgaaaaactttccgtcgaattgaaacaaagattgtatacagatgtattctgcaaatatagaaaagtaactgtaaagaagattaaaaactaccttaaatgtgaaggcattatcagcggaaatgttgagatcactggtatcgatggtgattttaaggcatctttaaccgcatatcacgactttaaggaaatattgacgggtactgagcttgctaaaaaagacaaagagaacattatcaccaatatcgtgctcttcggagacgacaagaaattattgaaaaagagattgaaccgcctataccctcagattacccctaaccaattgaagaaaatctgcgctctgtcttatactggatggggtcgttttagcaagaagtttctagaagaaattactgctccggatcctgaaactggggaagtctggaatataattaccgcgctatgggaatcgaataataatttaatgcaattactatctaatgaatacagatttatggaagaagtcgaaacttacaatatgggaaaacaaacaaaaactttgagctacgaaacagtagagaatatgtatgtctcaccatctgtaaagcggcagatctggcaaaccttgaagatagttaaagaattagaaaaagtgatgaaggaaagtccaaaaagggtttttattgaaatggcccgagaaaaacaagaatctaaaaggacggaaagtaggaaaaagcaacttatagatctatataaagcctgcaaaaatgaagaaaaagattgggtaaaggaattaggtgaccaggaagagcaaaaattgagatctgacaagctgtacttgtattatacgcaaaagggccggtgtatgtattcgggtgaggtaatagaattgaaagatttatgggataacactaagtatgacattgaccatatttacccccagtctaagacaatggacgattcattaaataaccgagttcttgtcaaaaagaagtacaatgccacaaagagcgataagtacccattgaacgaaaatataagacatgaacgaaaaggtttctggaaatcattgttggacggtggatttatttccaaagaaaaatacgagagattgattagaaacactgaactatctccagaggagttagctggctttatcgaaagacaaattgttgaaactagacagtctacaaaagcagttgcagaaatcttaaaacaagtatttccagaatccgaaattgtgtacgtcaaagccggaacagtaagtagatttagaaaagactttgaattattgaaagtacgagaggttaacgacctacatcatgctaaggatgcttatttaaatatagtcgttggtaattcgtattacgtgaaattcacaaaaaacgcatcttggttcatcaaggagaatcctggtaggacatacaacttgaaaaagatgtttacatcaggatggaatatcgaaagaaatggtgaggttgcgtgggaggtaggcaagaagggaaccattgttactgtaaagcaaattatgaataaaaacaatatacttgttacgagacaggtgcacgaagccaaaggagggttgtttgaccagcaaatcatgaagaaaggtaaaggtcagatagcaataaaagagactgatgagcgtttagctagtatagaaaaatatgggggctacaataaggcagctggtgcttacttcatgttggtcgaatcaaaggataaaaaagggaagacgatccggaccatagagtttatccctctgtacttgaagaataagattgagtctgacgaaagcatcgcattgaatttcttggaaaaggggcgcggtctaaaggagccaaaaatattgttaaagaaaattaaaatagacaccctattcgacgtcgatgggtttaagatgtggcttagtggtcgtactggggacagattattattcaagtgtgccaatcagttaatccttgacgagaaaatcattgttacaatgaaaaaaattgttaagtttattcaaaggcgacaagaaaatagagaactaaagttgagtgataaggatggaatcgataatgaagtgttaatggagatttataacacttttgtcgacaaattggagaatacggtgtacagaattaggctatctgaacaggctaaaaccctaattgataaacagaaggagtttgagcgactttctcttgaagacaaatcttcaactcttttcgagatcctacatatctttcagtgtcaatcttctgcagctaatttgaaaatgattggaggtcctggtaaggctggtatattagtcatgaacaacaacatatctaagtgtaataagattagtataattaaccaatcaccgacaggtatctttgaaaatgaaattgatttacttaaa

SEQ ID NO: 136 - DNA, 3858 bp, Artificial Sequence
  Description of Artificial Sequence: Synthetic polynucleotide
atgaaatcattcgactcgttcaccaacttgtactccctgtctaaaacattgaaatttgaaatgcgacctgttggtaacacccaaaagatgttagataatgcaggagttttcgaaaaggataaactgatccagaaaaaatacggtaaaacgaaaccatatttcgataggttgcatcgggaatttatagaagaagctttgactggtgtagaattaattggcttagatgagaatttccgtactctagtcgattggcaaaaagataaaaagaacaatgttgccatgaaggcatacgaaaatagtctacaaagactaagaacagagatcgggaaaattttcaatttgaaggcagaagactgggtgaagaacaaatatccaatattgggtcttaagaataagaatactgatatattgttcgaggaggccgttttcggtattcttaaggcaagatatggtgaagagaaagacacgtttattgaagttgaggagattgataaaaccggtaagtccaaaatcaaccagatctctatcttcgacagttggaagggcttcactggttattttaagaagttcttcgaaactaggaagaacttctataaaaacgatggtacttccacggctattgctacaagaattatcgaccaaaaccttaagcgttttattgataacctatcaattgttgaaagtgttcgacagaaagtagatttggctgaaactgaaaaatcttttagtatctccttatcccagtttttctctatagatttttataataaatgtttgctgcaagatggcattgactactataataaaataattggtggagagacattgaaaaacggagagaagctgattggccttaatgagttgataaatcaatatagacaaaataataaggaccagaaaatccctttctttaaattgctagacaaacagattttgtctgaaaagatcctattcttggatgaaataaagaacgatactgaattgattgaagctttgtcccagtttgctaaaacagctgaagaaaagacaaagattgtgaaaaaattgtttgctgatttcgtagaaaacaattctaaatatgatctagcccagatttatataagtcaagaagctttcaatacaataagtaataagtggacaagtgaaacagaaacttttgctaagtatttattcgaagccatgaagtctggtaaacttgccaaatacgaaaaaaaagataacagttataaatttccagactttatagccctttcacagatgaagtctgccttattgtcgatatccttagaaggtcatttttggaaggaaaaatattataagataagcaagttccaagaaaagactaattgggaacaatttttggctatatttctatatgagttcaattcattattttccgataaaatcaacactaaggatggagagactaagcaagttggctactatttgttcgcaaaagatctgcacaatttgattctatcagaacaaatagatataccaaaagattcaaaggtaactataaaggatttcgcagattccgtcctcaccatttatcaaatggctaaatattttgccgttgaaaaaaagagagcgtggttagcagaatacgagttggactcgttttatactcagccagatactggatacttgcaattctacgataatgcatacgaagacattgtacaggtatacaataaacttagaaattacttaaccaagaagccctacagtgaagaaaaatggaagctgaactttgaaaattcgactttggcaaatggttgggataaaaataaagaaagtgacaactccgcagtgattttgcaaaagggtgggaaatattacttgggtttaatcacaaaaggccacaataagatttttgatgatagatttcaagaaaaattcatagttggtatagaaggtggcaaatacgagaaaattgtctataaattcttccctgatcaagccaaaatgttcccaaaagtttgcttttctgctaaaggattggagtttttccggcctagcgaggagatccttcgtatctacaacaatgctgaattcaaaaaaggagaaacctatagcatagattctatgcaaaaactgatagatttttataaggattgtttaacaaagtacgaaggctgggcctgctatacatttagacatttaaagcccacagaagaataccaaaataacattggtgaattctttcgggacgttgccgaagacggctataggatcgattttcaaggtatctcagatcaatatatccacgaaaagaacgagaagggtgagctgcaccttttcgaaattcataataaggactggaatttggataaggcgagagatggtaaatcgaagaccactcaaaagaacttgcatactttatattttgagtccttgttttctaatgataacgtcgtccaaaattttccaataaagttgaatggacaagcggaaattttctatcggcctaagacagagaaagacaaattagaatcaaagaaagataaaaagggaaataaagtcattgatcacaaacgatactctgagaataaaatatttttccacgtaccattgacactcaacaggactaagaatgactcttatagatttaatgctcagattaataattttttggcaaataacaaggatattaacataattggggtggatagaggtgaaaagcacttggtatattactctgtcatcactcaggcttctgatatattggaaagcgggtctctaaatgaattgaacggtgttaactacgccgaaaagctaggtaaaaaagctgaaaacagagagcaggctcggcgcgattggcaagatgttcaaggaattaaagaccttaaaaaaggctacattagtcaagtagttagaaagttagccgatcttgctattaaacataacgcaatcattattctggaggacctaaatatgcgttttaagcaagttaggggtggcatagaaaaaagtatttatcagcagcttgagaaggctttgatagataagttatcgttcctagttgacaaaggtgaaaaaaatcctgaacaagctggtcatctgttgaaagcttatcagctgagcgcaccttttgaaacatttcaaaaaatgggaaaacaaacaggtattattttctatactcaagcgagttatacaagtaaatctgacccagtgacaggatggagaccacacctttatctaaaatatttttctgctaaaaaggccaaagatgacatcgctaagtttacaaaaatagaatttgtcaacgatagatttgaattgacttacgatattaaagattttcagcaagcaaaagaatacccaaataagacagtgtggaaagtatgctccaatgtggagagatttagatgggataaaaatctcaatcaaaacaagggtggttacacacattatactaatataactgaaaatattcaagaattgtttactaagtacggaattgacataaccaaagacttactaactcagatttcaactattgacgaaaaacaaaatacctcatttttccgcgactttattttttatttcaacttgatctgtcaaattcgtaacacggatgattccgaaattgccaagaagaacggaaaagatgatttcatcctatctccagtggaaccattttttgactcaagaaaagataatggtaataagttgcctgagaacggagatgataacggcgcttataatatcgctcggaagggtattgtaattcttaataaaatatctcagtactctgaaaagaacgaaaactgcgagaaaatgaagtggggcgacttgtatgtatctaatatagattgggataatttcgttactcaagccaacgcgagacattga

SEQ ID NO: 137 - DNA, 3465 bp, Artificial Sequence
  Description of Artificial Sequence: Synthetic polynucleotide
atggaaaattttaaaaacctatatccaattaataagacacttagattcgagcttaggccatacggcaaaacactagaaaattttaagaagtcaggcctattagaaaaagacgcctttaaggcaaattccagaagatcaatgcaggcaattattgatgagaaatttaaagagactatcgaggaaaggttgaaatacactgaattctctgagtgcgatctgggaaacatgacttccaaggataaaaagattaccgataaggctgctaccaacctcaaaaagcaagtcatcttatcgtttgatgatgaaatttttaataactacttaaagccggacaaaaacattgacgccctattcaaaaatgatccgtccaaccccgtaatttcaacttttaagggttttaccacgtactttgtaaatttttttgagattcgtaaacatatcttcaaaggagaatcgtcgggttccatggcctataggataattgatgaaaatcttacgacttacttaaacaatatcgaaaagataaaaaagttaccagaagaattaaagtctcaattggaaggtattgaccaaatagacaaattaaataactataatgagttcataactcaaagcggtatcacacattacaatgaaattatcggtggtatatctaaaagtgagaacgtaaaaatacagggaataaacgaggggatcaatctatactgtcagaagaataaagtaaaattaccaagactaacgccattatacaaaatgattctgtctgatagagtttccaactcgttcgtgcttgatactatagaaaatgatactgaattaattgagatgattagcgacttgattaataaaacagaaatatctcaagacgtaataatgtcagacattcagaacattttcataaaatataaacagcttggtaatttaccggggataagttactctagcatcgtgaatgctatttgctccgattatgacaataattttggtgacggaaaaagaaaaaaatcatatgagaacgataggaagaaacaccttgaaacaaacgtatactcaattaactatatatcggaactgttaacagacaccgatgtatcatctaatataaaaatgagatataaggaacttgaacaaaattaccaggtgtgtaaggagaatttcaatgctaccaactggatgaacattaagaatattaaacagagtgaaaagacaaacttgattaaagatctactagatatactgaaatcaatacagagattctacgatctgtttgatatagttgatgaagacaaaaatcctagtgctgagttttacacgtggctaagtaaaaatgcggaaaagttagatttcgagttcaactctgtttataataaatctaggaattatttaactagaaagcagtattctgataaaaagataaaattgaacttcgactcccctacgttggcaaagggttgggatgcaaacaaagaaatcgataactccaccataataatgcgtaagtttaacaatgataggggggattacgattattttttgggaatttggaacaaatctaccccagcgaatgaaaaaattattccccttgaagacaatggtctttttgaaaaaatgcagtataaattatatccagacccatccaagatgcttccaaagcaatttctgtcaaaaatttggaaggctaaacaccctactactcctgaatttgataagaagtataaggagggccgacacaaaaagggtccagattttgaaaaagaattcctgcatgaattgatagattgttttaagcatggtttggtaaatcatgatgaaaaatatcaggatgtctttggattcaatttgagaaatacagaggattacaactcatatacagaatttctcgaggacgtcgaacgttgcaattataatctcagtttcaacaagatcgcagacacttcaaacttaattaacgacggaaaattgtacgtttttcaaatctggtcgaaagactttagtattgattcaaagggtacaaaaaacctaaatacaatatatttcgaaagtctattctcggaagaaaacatgatcgaaaaaatgttcaaactgtcaggcgaagctgaaatattctaccgtcccgcaagccttaattattgtgaggatatcattaaaaaaggacatcaccatgcagagttaaaagataaattcgattacccaataattaaagataaaagatactcccaggataagttctttttccatgtacctatggttattaactacaagtcggaaaaactaaactcgaagtcattaaataatagaactaacgagaacttgggacaattcacacatataattggtattgatcgtggcgaaagacatttaatatatctgactgttgttgatgtttcaacaggagaaattgttgaacagaaacatcttgatgaaattataaacacagatacaaaaggcgttgagcataaaactcattatctaaataaattggaggaaaagtcgaagactcgcgataacgagagaaagagttgggaagcaattgaaaccataaaagagcttaaagaaggttacattagtcacgtcatcaatgaaatacaaaagttacaagaaaagtataacgctttgattgtaatggaaaatctaaattatggttttaagaattcaagaatcaaagtcgaaaagcaggtctatcagaaatttgaaacggcacttattaaaaagtttaactacattattgataaaaaggacccagaaacttatattcatggttaccaactgacgaacccaatcacaacattggacaaaattggaaaccaaagtggaattgttttatacattccagcttggaatacatccaaaatagaccctgtcacggggtttgtcaacttgttatatgccgacgatttaaagtataaaaaccaagaacaagcaaagtcttttattcaaaagattgataatatttatttcgaaaacggtgaatttaaattcgacatagatttttctaaatggaacaaccgttattcaataagtaaaactaaatggacactcacctcatacggcactcgtatccaaacctttcggaatccccaaaaaaataacaaatgggattctgcagaatacgacttgaccgaggaatttaaattaattcttaatatagacggtacactcaaaagtcaagacgtggagacatacaagaagtttatgtcgttattcaagcttatgcttcagttgaggaactccgttacaggcactgatattgattacatgatttcaccagtaacggataagactgggactcatttcgattctagggaaaatattaaaaatttacctgctgacgcagacgcaaacggcgcatacaatatagcaagaaaagggattatggccattgagaatattatgaatggcatatcagatccattaaagataagcaatgaagactacttaaaatacattcagaatcagcaagaataa

SEQ ID NO: 138 - DNA, 3924 bp, Artificial Sequence
  Description of Artificial Sequence: Synthetic polynucleotide
atgacccagtttgaaggtttcaccaatttgtaccaagtaagtaaaaccttgaggttcgaattgatcccacagggcaagacattgaagcatattcaagagcaaggatttatagaagaagataaagcgagaaacgatcactataaagagttaaaacccattattgacaggatctataaaacatacgccgatcaatgccttcaattagtgcaattagattgggaaaacttgagcgctgccatcgattcctacaggaaggaaaaaacagaagaaacaagaaatgccttaatcgaggaacaagcaacctatagaaacgctatacacgattacttcatcggtagaactgataatctaacagatgcaataaataagagacatgctgagatatataaaggactatttaaagcagaattattcaacggaaaggtgttgaaacagttaggtaccgttacaactactgagcatgaaaatgccttgctgagaagctttgacaagtttactacctacttttcgggtttctacgaaaatcgcaaaaatgtattttctgcggaagatatttcaactgcaatccctcataggattgttcaagataatttccctaagtttaaagagaactgtcacatttttacaaggttaattactgcggttccaagtctaagagaacattttgagaatgtaaaaaaagcgattggtatatttgtatccactagcattgaagaggttttcagcttccctttttataaccaattacttacccaaacacagatcgacctgtacaaccaattgttaggtggtatatcgagggaggctggtacggaaaagattaaaggattaaatgaagttcttaatttggccatacaaaaaaatgatgaaaccgcgcacattatcgcatctttaccacataggtttataccgttattcaagcaaatattatctgatcgtaataccttatcgttcatattagaggagtttaaatctgacgaagaagttatacaatctttttgcaagtataagacgctattgagaaacgaaaacgttctggaaacagccgaagcactgttcaatgaattaaacagtatcgacttgactcatatttttatatcgcataaaaagttggagacaatttcttcagcattgtgcgatcactgggacactttaaggaacgcactatatgaacgtaggatctcagaattgacaggtaagataacgaagtctgctaaagagaaagtgcagagatccctaaaacacgaggatataaatttgcaggagataatttcagctgcaggtaaagagttgtctgaagcgttcaagcaaaagacttccgaaatcttgtcacacgcacacgccgcattagatcaacctttacccactactttgaaaaaacaagaagagaaggagatattaaaatcacaacttgattctttacttggcctttatcatcttttagattggttcgctgttgacgagagcaatgaagtggatccagagttttccgcaagattgaccggtataaagttggaaatggaaccttcgttatcattttacaacaaagctaggaactatgctacaaaaaaaccttattctgtcgaaaaatttaaactgaacttccaaatgcctactctagcaagtggctgggatgttaataaagaaaagaacaatggcgctattttgtttgtaaaaaatggcctatactatcttggaattatgcctaaacaaaaaggtcgctacaaggctttgtcatttgaacctactgaaaagactagcgaaggtttcgataagatgtattacgattatttcccggatgccgctaaaatgatccccaagtgctctactcaattgaaggcagtaactgctcatttccaaacgcataccacgccaatactgctttctaacaactttatagaaccactagaaataacgaaagaaatttacgacctaaataacccagagaaagaaccaaaaaagttccagacggcctacgccaaaaagacaggggaccaaaaaggttaccgcgaggcgttatgtaaatggattgattttactagggactttttatcaaaatacactaaaacgacgtctattgatcttagctccttacgcccgtcctcccaatacaaggatctaggtgagtattacgcagagttgaacccgctattataccatatttccttccaaaggattgctgaaaaggaaattatggacgctgttgaaactgggaaattgtacctgtttcagatttataataaggacttcgcaaagggtcaccatggtaagcctaaccttcacactttgtactggaccggactattctcgcctgaaaatttggctaaaacaagtatcaagttaaacggtcaggccgagttattttatagacccaaatctagaatgaaaagaatggcccatagattaggcgaaaagatgttaaacaagaaattaaaggaccaaaaaaccccgataccagacactctataccaagaactgtacgactatgtgaatcacaggcttagtcacgatttatcagatgaagcgagggctttattgccaaatgtcatcaccaaggaagtatcacatgaaataattaaggatagaaggttcacatctgataaattcttttttcatgtcccaattacattgaattatcaagcagcgaactcaccatctaaatttaatcagcgcgtcaacgcctatttgaaagaacatcccgaaacaccaatcatcggcatagatcgaggtgagagaaacttaatatatataactgtgattgattctacaggaaaaatcctggagcaacgatctttaaataccatacaacagtttgattatcaaaaaaagttggataacagagaaaaagaacgtgttgccgctaggcaggcttggtctgtggtaggaacaattaaggacttaaagcagggctatctgtcccaagttattcatgaaatagtcgatctgatgatacattatcaggcagttgtcgtgttggaaaatttgaattttggctttaaatcaaaaagaactggcatagcagaaaaagctgtgtaccagcagtttgaaaagatgttaatcgataagctaaactgccttgttcttaaagattaccccgcagaaaaagtaggtggtgttcttaatccatatcagttgacagaccaatttacatcctttgcgaaaatgggtacgcaaagcgggttcttattctacgtaccggccccctatacttctaagatcgacccactaacaggttttgtggacccttttgtttggaagacgataaagaaccacgagtcacgcaaacatttcttagagggctttgatttcttgcactacgacgtgaaaactggtgattttatcttacactttaaaatgaacagaaatctctctttccaacgtggactgcccggattcatgccggcttgggacatcgtttttgaaaagaatgaaacgcagtttgacgccaaaggtacaccatttatagcgggtaagagaattgtgccggtcatagaaaaccatagatttacaggtagatatagggatctgtaccctgctaatgaattgattgcattactcgaagagaaaggaattgtgtttcgagatggatcgaatattttacctaagttgttggaaaatgatgattcacacgcaattgatactatggttgccctcataagatcggtattgcaaatgagaaactcaaatgctgctacgggagaggattatataaacagccccgttcgcgatcttaatggtgtttgttttgattcacgttttcagaaccccgaatggccaatggatgccgacgcaaacggagcatatcatattgctcttaaaggccaactactattaaatcacttaaaggaatccaaagacctaaaattgcaaaacgggatatctaatcaggattggctggcttacatacaagaactacgtaactag

SEQ ID NO: 139 - DNA, 3390 bp, Artificial Sequence
  Description of Artificial Sequence: Synthetic polynucleotide
atggccgttaagtcaatcaaagtgaaacttagactggatgacatgccagagattcgtgcggggttatggaaacttcataaggaagttaacgcaggggtaagatattataccgaatggttatcattacttcgacaagagaatttgtacagaaggtccccgaacggcgacggtgagcaagaatgcgataagacggctgaagaatgtaaggcagaacttttggagcgcctgagagcccgtcaggttgaaaatggccatagaggtcctgcgggatctgatgatgagcttttacagctagctagacaattgtatgaattgttggtccctcaggctattggggctaaaggagacgctcaacaaatcgccagaaagttcttgtcacctctggctgacaaagatgccgtgggaggattaggtatcgctaaagcaggtaataaaccaagatgggttagaatgagagaagcaggcgaacctggttgggaagaagagaaagaaaaggccgaaactagaaaaagcgctgacagaaccgcagatgttttacgggccttggctgattttggactgaagcctttgatgagagtgtatactgattcagaaatgtcttccgttgaatggaagcccctaaggaagggacaagcggtcagaacctgggatagggatatgtttcaacaggctattgaaaggatgatgtcatgggaatcctggaatcaaagagtaggtcaagaatacgctaaactggtcgaacaaaagaatagatttgaacaaaaaaattttgtaggtcaagaacatttagtacatttggttaatcaacttcaacaagatatgaaagaggcatctcctggtttggaatcaaaagaacaaacagcacactatgttaccggccgagctttgcgaggttctgacaaagtatttgaaaagtgggggaaattagctcccgatgccccctttgatctatatgatgctgaaattaaaaacgttcaaagaaggaacactagacgttttggatcccatgatctttttgcaaagctagctgagccagaataccaggctctatggcgtgaagacgcctcgtttttgactagatacgcagtatacaattcaatactcagaaaactaaaccatgccaagatgtttgctacattcaccctgcccgatgctaccgctcatcctatttggactagatttgacaagttgggggggaatctacatcagtacacatttttatttaatgaattcggtgaaagaagacacgctattagattccacaagctcctaaaggttgaaaacggcgttgcgagagaagttgatgatgtaacagttcccatttctatgtcggagcaattggataatctattgcctagagaccctaatgaaccaattgctttgtactttcgtgactacggtgcagaacaacactttacaggtgaattcggcggagccaagattcaatgtagacgtgatcaactcgcacacatgcatagaagaagaggcgctcgtgatgtttatttaaatgtgtctgttagagttcaatcccaatcggaggctagaggtgaaagaaggccaccatacgcagcagtttttaggttagtaggtgataatcatagggcatttgtccacttcgacaaattaagtgattatttagcagagcaccctgatgatggaaagttgggcagtgagggattattaagtgggttgagggtaatgtctgtagatcttggtcttcgtacttctgcgagtatctctgtctttagagtagcacgtaaggatgagttgaaacctaatagcaaaggaagagtcccgtttttttttcctattaagggtaacgataacctggtggccgtgcatgaaagatcacaacttttgaaattgccaggagaaacggagtccaaggacttgagggcaattagagaggaacgtcagcgtacattgcgacagctgagaactcaattggcttatttgaggttgttggttaggtgtggttccgaggatgttggcagaagagaaaggtcttgggccaaattgatagaacaaccagtggacgccgcaaatcacatgacaccagattggagagaagctttcgaaaatgaactccagaaattaaagagcctacatggcatatgctctgataaagagtggatggatgccgtatacgaatccgttcgtagagtctggcgccacatgggtaagcaagtacgggactggagaaaggatgttcgttccggcgaaagaccgaagataagggggtatgcaaaggacgttgtaggcggtaattctattgaacagattgagtatttggaaaggcagtacaaatttcttaaatcctggagcttcttcggcaaagtgtcaggacaagtcatcagggctgaaaaaggttccagatttgctattacgctaagggaacatattgatcatgcgaaagaagatagactgaaaaaactagcagatagaataattatggaagcacttggttacgtctatgcacttgatgaaagaggcaaggggaaatgggtagctaaatacccgccttgtcaacttattttattagaagaattaagcgagtaccaatttaacaacgatagacctccatccgaaaataatcagctgatgcaatggtcccataggggtgtttttcaagaattgataaatcaagctcaagtacacgatttgctggtaggtactatgtacgcagcgttttcgagccgttttgatgcaagaactggtgccccaggtatcagatgtcgacgtgttccggccagatgtacacaggaacataaccctgagccatttccgtggtggcttaataagtttgttgtcgagcacacattagacgcatgccctctgagagcagatgaccttatacccactggagaaggcgaaatatttgttagtccattctctgcagaagaaggtgactttcaccagatacatgcagacttaaatgcagcacagaatctccaacaaaggttgtggtcggattttgatatttcgcaaataagactaagatgcgattggggagaggttgatggagaattggtgctgattccaagattaaccggaaagcgaactgccgattcctattctaacaaggtgttttacacaaatactggtgttacctattacgaaagagaaaggggtaagaagagacgtaaagtatttgctcaagaaaaattgtcagaagaggaggcagaactgttagtagaagcagacgaagccagagaaaaatcagttgtgcttatgcgtgacccttccggcattataaatcgtggtaattggacacgacaaaaagaattttggtctatggtcaatcaacgtatcgaaggctacctagttaagcaaatcaggtctagggttccactacaagatagcgcatgtgaaaatacgggtgatatataa

SEQ ID NO: 140 - DNA, 3327 bp, Artificial Sequence
  Description of Artificial Sequence: Synthetic polynucleotide
atggctactagatctttcattttaaaaattgaacctaatgaagaagtgaagaagggtctctggaaaactcacgaagtacttaatcatggcattgcctattatatgaatatcctgaagcttattcgtcaagaagctatatacgagcatcatgagcaagatcctaagaaccctaagaaagtaagcaaagcggaaattcaggctgaattgtgggacttcgtcttgaagatgcagaagtgtaacagttttacgcacgaagttgataaagatgtggtgtttaatattttgagggagctatatgaggagttggtgccctcgagtgtcgaaaaaaaaggagaagctaatcagctgtcaaataaatttttatatcctctggtggatccaaactctcaatcaggtaaaggcactgccagtagtggtcgaaaaccgagatggtataatttgaaaatcgcaggtgatccatcgtgggaagaagaaaaaaaaaaatgggaagaagataaaaaaaaagatccccttgccaaaatactaggtaagctagccgagtatggacttataccattattcattcctttcacggactctaatgaaccaattgtgaaggaaatcaaatggatggaaaaatcacgtaatcagtctgttaggaggttggacaaagatatgtttatacaggctcttgagaggtttttgtcgtgggagtcctggaatttgaaagtgaaagaagaatatgaaaaagtggaaaaggagcataagacgttggaagaaaggattaaggaagatattcaggcctttaagagtctggaacagtacgaaaaagaaagacaggaacagttattgagagatactctaaacactaatgaatataggctttccaagaggggcttgcgaggatggagagagataattcagaaatggttgaaaatggatgagaacgagccatcggagaaatatctagaggtgtttaaagattaccaaagaaagcaccctcgcgaagctggtgattactctgtttatgaattcctttcgaagaaggaaaatcacttcatctggcgaaatcatccagagtacccatatttatatgctacattttgcgaaattgacaagaaaaaaaaagatgctaaacagcaagcgacattcaccctcgctgatcccatcaaccacccattatgggtcaggttcgaagagagatcaggctcgaacctgaataagtacaggatcttgactgagcaattgcatactgagaagttaaaaaagaaattgacggtccaacttgacagattgatttatcccactgaatctggtggatgggaggagaaaggtaaggttgatattgtcctattgccttctcgtcaattttacaaccaaatatttctggacatcgaagagaagggtaaacatgcttttacctataaggatgagagtattaaatttccattgaagggaacgcttggcggcgctagagttcagttcgatagagatcatttgagaagatacccgcataaagtggaatctggtaatgtaggtcggatctactttaacatgacggtaaatattgaacctaccgagtcaccagtcagtaagtctttaaagattcatagggatgatttccctaaatttgtcaacttcaagcctaaggaactaaccgagtggatcaaagacagtaaaggcaaaaagttaaagagcggtattgagtccctggagataggtcttagagtcatgtctatcgatttgggtcaaagacaagcagccgcagcatctattttcgaagttgttgaccaaaaaccggatatcgaggggaaattattttttccaataaaaggaactgagctatacgctgtgcatcgcgcatccttcaatataaaactgccaggagaaacactagtaaaatctagagaggtcttgcgtaaagcacgtgaggacaatctcaaattaatgaatcagaagttaaatttccttaggaacgtgttgcatttccaacagttcgaggacataactgaacgcgagaaaagagtcactaagtggatctcaagacaagaaaatagtgatgtgccattagtgtatcaagacgaacttattcaaataagagagctaatgtataaaccatataaagactgggtggcattcttaaaacaattacacaagcggcttgaagtagaaataggaaaagaagtaaagcattggaggaagagtctgtccgatggtcgcaaaggcctgtacgggatatcacttaaaaatattgatgaaattgacagaacacgaaaatttttgttaagatggtcattgagaccaaccgaaccaggtgaggttagaaggttggaaccaggccaaaggtttgccatcgatcaattaaaccatcttaacgcactgaaagaagatagattgaagaagatggcgaacactattattatgcacgctctaggttattgctatgatgtgagaaagaaaaaatggcaagccaagaaccctgcatgccaaattattttgtttgaagatctttctaattacaatccatacgaagagcgttcacgttttgaaaactctaaattgatgaaatggtctagaagagagattccgagacaggtcgctctacaaggggagatttacggtcttcaagtcggtgaggttggtgctcaattttcttccagatttcatgcaaaaactgggtctccaggcattaggtgttcggtcgttactaaggaaaagttacaggacaaccgtttcttcaaaaatttgcaacgtgaaggccgtttaacacttgataagatagctgtccttaaggaaggcgatctgtacccagataaaggtggtgagaaattcatatctttgagtaaagacaggaaactggttacaacacacgccgacattaacgcagctcagaacttgcaaaagagattctggacaaggacccacggcttctataaggtgtactgtaaagcttatcaagtagatggacaaacggtttatattcctgaatcaaaggaccagaaacaaaaaattatagaagaatttggtgaaggatactttatcttgaaggatggagtttatgagtggggcaatgcaggtaagttaaagataaagaaaggttcatcaaagcaatcaagtagcgaactggtcgattcggatattttaaaggatagctttgatctagctagtgaattgaagggagaaaagttaatgttatacagagatcccagtgggaatgtatttccatctgataagtggatggccgccggagtgttttttggcaaattagagagaatcttgatttctaaactgaccaatcaatactcaatttcgaccatcgaagacgactcttcaaaacaatccatgtga

SEQ ID NO: 141 - DNA, 3450 bp, Artificial Sequence
  Description of Artificial Sequence: Synthetic polynucleotide
atgcctactcgcaccatcaatctgaagttagttttggggaagaacccagaaaatgcgactctaagacgggcactattctctacacatagacttgtcaaccaagcgactaagagaattgaagaatttttactgttgtgtagaggagaagcttatcgtaccgtagataatgaaggtaaagaagctgagatcccacgccatgctgttcaagaagaggcgcttgcttttgcaaaagctgcacaacgacataacggctgtatctccacatatgaggaccaggaaatcttggatgtgcttagacaattgtatgaaagattagtacctagcgtcaatgaaaacaacgaggctggggatgcccaagccgctaacgcttgggtgagtccattaatgagtgcagagtccgaaggtggactatcggtctatgataaagtgttagacccgccgccagtatggatgaaactcaaagaagagaaagcgcctggttgggaagctgcttctcagatttggatacagtccgacgaaggtcaatcgctgctaaataaaccgggtagcccaccacgttggattagaaaacttagatctggtcaaccgtggcaagatgacttcgtttcagaccaaaaaaaaaagcaagatgaactaacgaaaggtaacgcaccactcataaaacaattgaaagagatgggcctcttgcctttagttaatcccttttttagacatttgttggatcccgagggtaagggtgtatccccatgggacagattggccgtaagggccgcggtggcgcacttcatctcttgggaaagttggaaccacagaacaagagctgagtataacagtttgaaactgcgaagagatgaatttgaggccgcatctgatgaattcaaggacgattttacattgctacgacaatatgaggctaagcgacatagtacgcttaagtcaattgccttagctgatgactctaacccgtaccgaattggtgtaaggtccttgagagcctggaatagggttagagaagaatggattgacaaaggcgcaaccgaggaacaaagggttaccatccttagtaagcttcaaacacaattacggggtaaattcggtgatccagacctatttaattggctagcccaagatagacacgtacacctgtggtccccgagagattccgtcacgcccctcgtaaggattaatgccgtcgacaaagtgcttagaagacgtaagccttatgcactgatgacttttgcacatccgagattccatccaagatggattctatacgaagcgcctggtggttctaacttgcgacaatacgctttagattgtactgaaaatgctctgcatattacacttccattactcgtcgacgacgcccatggtacatggattgagaaaaaaatccgcgtaccactcgctcctagtggacaaatacaagatttaactttagaaaaacttgaaaagaaaaaaaacagattatactatagatcaggattccaacaatttgctggattagccggtggtgctgaggtgttgtttcataggccgtatatggaacatgatgagagatcagaagaatctctgttggaaaggccaggcgctgtgtggttcaaattaaccttagatgttgctacccaagcaccacctaactggttagatggtaaaggcagagttaggacacctccagaagttcatcatttcaaaaccgctctgtcaaataaatctaaacatacgagaaccttgcaaccaggattgagagtcctttctgttgatttgggtatgagaacatttgcttcttgttctgttttcgaattgatcgaaggtaaacctgaaacaggtagagcattccctgttgctgacgaaagatcaatggatagtccaaataagttatgggccaagcacgagagaagctttaaactaactctgcctggagaaacaccgagcagaaaggaggaagaagagagaagcattgctagggcagagatttacgcgctgaaaagagatattcaaagactgaaatcactcctaagattaggtgaggaagataatgataatagaagagatgctttgttagagcaattctttaaaggatggggtgaagaggacgtagttcctggtcaagctttccctagaagcctctttcagggattaggcgctgcaccctttaggtcaacacccgaattgtggagacagcactgtcagacgtattacgacaaagcggaagcttgcctggcaaagcatatttccgactggaggaagagaactagacctcgtccgacttcgagagagatgtggtataagacaagatcttaccatggtggcaaaagtatttggatgctagaatacttagatgctgtccgcaaattactactttcatggtcgttaagaggtcgtacttacggagctattaatagacaagacaccgctcgttttggttccttagcttctagattgttgcatcatatcaactctttaaaggaagaccgcatcaaaaccggtgcagatagtattgtgcaggccgcaaggggctatattcctctcccacatggcaagggttgggaacagcgttatgaaccctgtcagttgatattatttgaagatctagctaggtacagatttcgtgtagacagacctcggagagagaattcgcaattgatgcagtggaatcatcgagctatagtagcagaaacgacgatgcaagctgaactatacggtcaaatagtcgaaaataccgctgctggtttctcctcaagatttcatgctgcaactggtgctcctggtgtcagatgtcgctttttgttagaacgagatttcgataatgacctaccaaagccgtacttactgagagaactaagttggatgttaggtaacacaaaggttgaatcagaggaagaaaaattgcgtcttctaagcgagaaaattagaccaggttcattagtcccttgggatgggggtgaacaattcgcgacattacacccgaaaagacaaactctttgtgtcattcacgcagatatgaacgctgctcaaaacctgcaacgcagatttttcggaaggtgtggggaagcctttcgccttgtgtgtcagccacatggtgatgatgttttgaggctagcgtctacaccaggtgcaagacttttgggtgcattacaacaactggaaaatggtcagggagctttcgaattagttcgtgatatgggtagcacatcacaaatgaatcgtttcgtcatgaagtcgttgggcaaaaaaaagatcaagccattacaagacaataacggggatgatgaactagaagacgtgctatctgttttacctgaagaagatgataccggacgaattactgtatttcgggactcttcgggtatattcttcccttgtaacgtttggatcccggcaaaacagttctggcctgcggtccgtgctatgatttggaaggttatggcatcacattcattgggttag

SEQ ID NO: 142 - DNA, 3759 bp, Artificial Sequence
  Description of Artificial Sequence: Synthetic polynucleotide
atgacaaagttaaggcatagacagaagaagttaactcacgattgggcggggtctaaaaagagagaagttctagggagcaatggtaaattacagaatccattgctaatgcccgtcaaaaaaggtcaggtgacagaatttcgaaaagcattttccgcatacgcccgagcaaccaaaggggaaatgacggatggcagaaaaaatatgtttactcactcatttgaaccattcaagaccaagccttcgttacatcagtgcgaactggctgacaaagcctaccagagcttgcattcatatttaccgggttctttggcgcattttcttttatctgcccatgcacttggttttaggatttttagcaaatcaggggaagccactgcattccaagcgtcctcaaagattgaagcttacgaaagcaagttagctagcgagcttgcttgtgttgatttgtctattcagaacttgactatttcaactttgttcaacgcattaacgacttccgtaagaggtaaaggtgaggagacatcggcagatccactgatagctagattttacaccttacttaccggtaaaccactaagcagagacactcagggcccagaacgagatttagccgaggtgataagcagaaaaattgcaagttcttttggaacttggaaggagatgactgccaatccacttcaatctcttcaattttttgaagaggagttgcatgcgctagatgcaaatgttagtttgtcacctgccttcgatgttctgattaagatgaacgacctgcagggtgacttgaagaacagaacgatagtttttgatccagatgctcctgtgtttgaatataatgctgaggatcctgctgacatcatcattaaactgacagctagatatgcgaaagaagcagtgattaaaaatcaaaatgtcgggaattatgttaagaacgctattacgacaactaacgcaaacggactaggttggttgctgaacaaaggcctttccttattgcctgtctccactgatgacgaactattggagtttattggggtcgagagatcccatcctagctgtcatgcgttgatagaacttatcgctcagttagaagcacctgaactgttcgaaaaaaatgttttttctgatactcgttccgaggttcaaggtatgatagattcagctgtaagcaatcatatcgccaggctgtcaagctctcgtaattcattgagcatggactcagaggaacttgagagattgataaaatcttttcaaattcatacaccacattgttcattatttataggggctcaatccttatctcaacaattggaaagcctacccgaagcattgcagtcaggagtgaacagtgctgatattctgctcggctcaacccaatacatgttgacaaattctttggtcgaggagtcaatcgctacgtatcagagaaccttaaatagaattaactacctgtccggcgttgcaggacagattaacggtgctattaagaggaaagctattgatggtgagaagatacatttacccgctgcttggtcagagttaatttctttaccctttattgggcaaccagtgattgatgttgaatcagatttagcccacttaaagaaccaataccagacattgtctaacgaatttgatacgctgatttccgcactgcaaaagaatttcgacttaaattttaataaagccttgcttaatcgaacacaacatttcgaggctatgtgtagatcaacaaaaaagaatgccctttctaagcctgagatcgttagttatagagatttgctagccaggttgacttcttgtctttataggggctctctagtcttgaggagggcgggtatagaagtactgaaaaagcacaagatatttgagtccaactctgaattaagagagcacgttcatgaaagaaaacacttcgtatttgtttctccgctcgatagaaaagccaagaagctcctacgtttgactgactctaggcctgatttattgcacgtaattgatgaaatactacaacatgataatttagagaacaaggatagagaatctttgtggttagttcgatctggttatttactggccggcctaccagaccaactctcctcttcctttataaatcttccaatcattactcaaaaaggcgatcgtcgcttgatagatctcattcaatacgaccaaattaatagagatgcttttgtgatgttggtaacttccgcttttaagtcgaacttaagtgggctgcagtacagagcaaacaaacaatcttttgtggttacgcgcactttgtcaccatatttgggatctaaattggtttatgtgcccaaagataaagattggctggtcccttcccaaatgttcgaggggagatttgcggacattttgcaatccgattatatggtgtggaaggacgctggaagattgtgtgttattgacacagctaagcatttgtctaacattaaaaaatctgtattctcaagtgaagaagtcctcgcgtttttaagagaattgccacaccgtacgtttatccaaactgaggtcaggggtttaggggtgaatgtggacggtattgcatttaataacggggatataccctctctgaagacgtttagcaattgcgtgcaagtcaaagtgagtcggacaaacactagtctggtccaaacattaaatagatggtttgaaggcggtaaggtctcgccgcctagcatccaatttgagagagcatattacaaaaaagatgatcaaatccacgaggacgctgcaaaaaggaagataaggtttcaaatgccagctacagagttggtacacgcgtcagacgacgcaggatggaccccctcctatttacttggtatcgatcccggtgaatatggtatgggtttgtcattggtctcaataaataatggcgaagttttagatagcggatttatacacataaattcattgataaatttcgcttctaagaaatcaaatcatcaaaccaaagttgttccgaggcagcaatacaagtcaccatacgccaactatctagaacaatctaaagattctgcagcaggagacatagctcatattttggatagacttatctacaagttgaacgccctacccgttttcgaagctctatctggcaatagtcaaagcgcagcggatcaggtttggacaaaagtcctcagcttctacacctggggagataatgatgcacaaaattcaattcgtaagcaacattggttcggtgcttcacactgggacattaaaggcatgttgaggcaaccgccaacagaaaaaaagcccaaaccatacattgcctttcccggttcacaagtttcttcttatggtaattctcaaaggtgttcatgttgtggacgtaacccaattgaacaattgcgcgaaatggcgaaggacacatccattaaggagttgaagattagaaattcagaaattcaattgttcgacggtactataaagttatttaatccagacccgtcaacggtcatagaaagaagaagacataatttagggccatcaagaattcctgtagctgatagaactttcaaaaatataagtccaagctcactagaattcaaagaactaataacgattgtgtcacggtctatacgtcattccccagaatttattgctaaaaaaagaggtataggtagtgagtacttttgtgcttatagtgattgtaattcctccttaaattcagaagcaaatgcggctgcgaacgttgcccaaaagttccaaaagcaattgtttttcgaattatag

SEQ ID NO: 143 - DNA, 3864 bp, Artificial Sequence
  Description of Artificial Sequence: Synthetic polynucleotide
atgaaaagaatcttgaactctttaaaggttgccgccctgcgtttgttatttagaggtaaaggatctgaacttgtcaagactgttaaataccctttggtctcgccggttcagggtgcagttgaggagttagctgaggcgatccgccatgataacctacatctgtttggtcaaaaagaaattgttgaccttatggaaaaggatgaaggtacgcaagtttactcagtggttgatttctggttagatacccttcgtttggggatgtttttcagtccatcagcaaacgcattaaaaatcacgctgggtaagtttaattctgatcaggttagcccttttaggaaagtgttagagcagtctccattcttcttggctggtaggctgaaggttgaaccggcagaacgtatattatctgtcgagatccgtaagattgggaagagggaaaacagagttgagaactatgctgctgacgtagaaacgtgttttataggccaattaagttcagatgagaaacagtcaatacaaaaattagctaatgatatctgggatagtaaagatcatgaagagcaaagaatgttaaaggcagatttcttcgctatccctttgattaaggatccaaaggctgtgaccgaagaggatcctgaaaatgaaactgctggtaaacaaaaacccttggagttgtgtgtctgccttgtcccagaactttacacaagaggattcgggtcaatagccgattttttggttcaacgcttaactcttttaagggataaaatgtctacagatactgcagaagattgtttagaatatgtcgggattgaggaggaaaaaggtaacggcatgaactcattgttgggaacgttcttaaagaatttgcaaggcgatggatttgagcagattttccaatttatgttagggagctatgtcggttggcaagggaaggaagatgttttaagagagagattagacttattggctgaaaaagtgaagaggttaccgaaaccaaaatttgctggcgaatggtctggtcataggatgttcttgcatggccaattgaagtcttggtcttcaaatttttttagactatttaacgagacaagggaacttctagagtctattaagtcagatatacagcatgccacaatgctaatatcatatgtagaagaaaaaggtggttatcatcctcaattacttagtcaatatagaaaacttatggaacaactaccagctttgcgtaccaaggtattggaccctgagattgaaatgacacatatgtccgaagcagttcgctcttatataatgatacataaatctgttgcgggttttttaccggatttattagaatcattagatagagacaaggatcgtgagtttctgcttagtatttttccaagaatcccaaaaattgataaaaaaaccaaggaaattgtagcttgggaactgccgggagaaccagaagaaggttatttatttactgctaataacttgttcagaaacttcttagagaatccgaaacatgtcccgagatttatggccgaaaggatcccagaagattggactcgattacgctctgctcctgtctggttcgatggaatggtaaaacaatggcaaaaagtcgttaaccagttagtagaatcaccaggtgctttatatcaatttaacgaatccttcttgagacaaaggttacaggccatgttaactgtgtataagagggacttacaaactgaaaaatttcttaaacttttggcggatgtttgtaggcctcttgtagatttttttggtttgggtggaaatgatattatttttaagagctgtcaagacccaagaaaacaatggcaaaccgttattcctctctctgttccggcagatgtctatactgcttgcgaaggtttggcgattagactaagggagacattaggattcgaatggaagaatttgaaaggtcacgagagagaagatttcttaagattgcaccagttattgggcaatttacttttctggattcgtgatgctaaattggtagtaaaattagaggattggatgaacaacccatgtgttcaggaatatgtagaagcccggaaagctatcgatcttccactagaaatattcggttttgaagtgcctatcttcctgaatggctatctattttcggagttgagacaattagaacttttgcttaggagaaaaagtgtgatgactagctacagtgtaaagactactggatctcctaataggctatttcagctagtttatttacctctaaaccctagtgaccccgaaaagaagaactcaaataactttcaagaacgtttggataccccaactggtttgtcccgtcgtttcctagacctaacccttgatgcattcgcaggtaagttacttaccgatccagttacacaagaattgaagacaatggcaggtttttacgatcatctttttggattcaaattgccatgtaaactcgccgccatgtcgaatcatccaggttcttcttcaaagatggttgtgttagcgaaacccaaaaaaggtgttgcttctaatatagggtttgaaccgatcccagatcccgctcatcccgtatttagggttagatccagttggccagagttgaagtacctcgaggggctattgtatttgccagaagacacacctttgaccatcgaattagcagagacctccgtatcgtgccaaagtgtctcgtcagttgcattcgatttgaaaaacttgacaacgatcttaggtcgtgtgggagaatttagggtcacagctgatcaaccctttaaactaacgcctataatcccggagaaagaagaatcttttattggtaaaacttatttgggtctcgacgcgggtgaaaggagcggcgtcggtttcgctattgttacagtggacggagatgggtacgaagtgcaaagattgggggtccacgaggatacacagcttatggccttgcagcaagttgctagtaaatccttaaaagagccagtatttcagcctctaagaaaaggcacctttagacaacaagaaagaatacggaaatccttacgtggttgctactggaatttttatcatgccttgatgataaaatatagggccaaagtagtacatgaggaatctgtcggaagtagtggtcttgtgggtcaatggttgagggcttttcagaaggatttgaagaaagccgatgttctccccaagaagggcggtaaaaacggtgtagataagaagaagagagagtcctcagctcaagacactctttggggtggtgctttctctaaaaaggaggagcaacagattgcgtttgaggtgcaagctgcaggttcttcgcaattttgtttgaagtgcggatggtggttccaactaggcatgcgtgaagtaaacagggtacaagaatcgggcgtcgtgttagattggaatagaagcatagttacctttttaatagaatcatccggcgaaaaagtttatggtttctccccacagcaattagagaagggtttcagaccagacatcgaaacttttaaaaagatggtaagagactttatgagacctcctatgtttgatagaaaaggcagaccggccgcagcttacgagagatttgttttaggaaggagacatcgaaggtacaggtttgataaagtatttgaggaaagatttgggaggtctgctcttttcatttgtcctagagtaggttgtggaaattttgaccacagctccgaacagtccgcggttgttttggccttgatcggatatattgccgataaggagggaatgtcaggtaagaagttggtttatgtacggctggccgaacttatggccgaatggaaactaaaaaaattagaaagatccagagttgaagaacaatcatccgctcaataa

SEQ ID NO: 144 - DNA, 3579 bp, Artificial Sequence
  Description of Artificial Sequence: Synthetic polynucleotide
atggcagaaagcaaacaaatgcagtgtaggaaatgtggagctagtatgaagtacgaagtcatcggtttgggtaaaaagtcatgtagatacatgtgtcccgattgtggcaaccatacctcggcaagaaagatacaaaacaaaaaaaaaagagataaaaaatatgggtcagccagtaaagcccaatctcaaagaattgctgtagcaggtgctctttaccctgacaaaaaagtacaaactatcaaaacctataaatatccagcagacttgaatggtgaggtgcatgatagcggtgttgccgagaaaatcgcacaagcaatacaagaggacgagattggacttttgggaccaagctcagaatatgcatgctggattgcatctcaaaaacagtctgagccttacagtgtagtcgatttctggtttgatgcagtgtgcgcagggggagtcttcgcctactctggcgctagattattgagtacagttttacagttatccggtgaggaatcggtgcttagagctgccttagcctcgtctccattcgttgacgatataaacttagcgcaagccgaaaagtttttggcggttagcaggcgtacaggtcaagataagttaggtaagagaattggggagtgctttgcagaaggaagattggaagctttagggataaaagatagaatgagggaatttgttcaagctatcgatgttgcacagaccgccggacaacgtttcgctgccaaattgaagatattcggtataagtcagatgccagaagctaagcaatggaataacgattccggactgactgtctgtatactacctgattattatgttcccgaagagaatcgcgcggaccaacttgtagtgttgttaagaagacttcgcgagattgcatattgcatgggtattgaagatgaagcgggtttcgaacatcttggaatagatcctggtgctctttcgaatttttcaaacggtaaccctaagagaggatttctagggaggctgttaaataacgatattattgcgttggcaaacaatatgagtgcgatgactccatattgggaagggcgtaagggtgaactcatagaaaggcttgcgtggttaaagcacagggcagaagggctgtatcttaaagaacctcatttcggtaactcctgggccgatcataggtcacgaattttctcaaggatcgcaggctggttatctggttgcgctggcaagttgaaaattgcgaaagaccaaatttctggagtacgtacagatctatttctgctaaaaagactgctggacgcagttccgcaatcggcgccatcccccgattttattgcgtcaatttcggcacttgacaggtttttagaagctgcagaatcgagccaggaccctgctgaacaagtgagggctctctacgcttttcacttgaacgcacctgcagtccgaagtatagccaataaagcagtgcaaaggtccgacagccaagaatggctgataaaagaactagacgctgttgaccatttagaatttaacaaagcgttcccatttttctctgacacaggaaaaaaaaaaaaaaaaggtgctaatagcaacggtgctccatcggaagaagagtacactgaaacggaatcaatacaacaacctgaggacgcggaacaggaagtaaacggacaagaagggaacggagcgtctaaaaatcaaaagaaatttcaaagaatacctagattcttcggtgaaggctccagatctgaatacagaattttaacggaagctccacagtatttcgatatgttttgtaataacatgagggctatatttatgcagttagaaagtcaaccccgtaaagctcccagagattttaaatgtttcctacaaaatcgattacaaaaattatacaaacagactttcttgaatgcacgaagcaacaagtgtcgcgctctgcttgagtcagttttaatctcttggggagaattttatacatacggtgccaacgaaaagaaatttagattaagacatgaagcttcagaacgcagcagtgacccagattacgtagttcagcaagccttggaaatcgcgcgtcgtctattcctttttggcttcgaatggagagattgctccgctggtgaaagagtggatttggttgaaattcacaaaaaggctatcagttttttgttggctattactcaagctgaggtctctgttggttcatacaattggcttggcaactcaacagtatcgagatatttatccgttgcgggaactgataccttatacggtacccaattggaagaattcctgaacgctacagtgttgagtcaaatgcgtggtctggccattagattgagttctcaagaacttaaggacggttttgatgtgcagctcgagtcttcctgccaggacaatctgcaacacctattggtgtatagggcttcgagagatttggcggcttgcaagcgcgctacttgtccagccgaactcgatcctaagattttagttttaccggtaggtgcattcatcgcttccgtaatgaaaatgatagaaagaggtgacgaacctttagctggtgcttatttacggcataggccacactctttcggatggcaaattagggtccgcggtgttgctgaggtagggatggatcagggtacagcattggcctttcaaaagccaacagagtcagaaccttttaaaattaagcccttctctgcacagtatggaccagttctgtggttgaacagtagtagttattctcaatcacaatatttggacggttttctatctcaaccaaaaaattggagtatgagggtgttgcctcaggcgggttcagttcgcgtcgaacaacgagttgctttgatatggaacttacaagcaggcaagatgagactagaacgctccggtgcgagggcctttttcatgcctgtaccgttttcatttaggccatccggcagtggggacgaagcagttttggcgcccaaccggtacttgggtctgttccctcattccggaggtatagaatacgctgtagtggatgtcctggattctgctggatttaaaattcttgaaagaggcactattgctgtcaatggtttctctcagaaaaggggagagcgccaagaagaagcccatcgtgaaaaacaaagaagggggataagtgatatagggcgaaagaagcctgtgcaggcagaagtcgatgcggcgaacgaattgcatagaaagtacactgatgttgccacaagattaggttgtagaatcgtcgttcaatgggcaccacaacctaaaccagggacagcaccgacagcgcaaactgtttacgcgagggctgttaggacagaagctccgaggagcggcaaccaagaagatcatgcaagaatgaaaagttcttggggttacacctggggtacgtattgggagaaacgaaaaccagaagatattttagggatttctacacaggtgtattggacaggaggtataggcgaatcctgtcctgctgtagcagtcgctttattaggtcatattagagcaacttcaacacaaacggagtgggaaaaggaagaagttgtctttggaagactgaagaagttctttccgagttaa

SEQ ID NO: 145 - DNA, 2958 bp, Artificial Sequence
  Description of Artificial Sequence: Synthetic polynucleotide
atggagaagagaattaataagatacggaaaaaattatctgcggataatgcaacaaagccagtctctcgttcaggccccatgaaaaccctgcttgtaagagtaatgacggatgatttaaaaaagaggttggaaaagcgtagaaaaaaaccagaagtgatgccgcaagtgatctcaaataacgcagctaataatctaaggatgctacttgatgattatacaaaaatgaaagaagcaatcctgcaagtttactggcaggaattcaaggatgaccatgttggactaatgtgcaaattcgcacaaccagcgtctaagaaaattgaccaaaataaattgaaacccgaaatggacgaaaaagggaatttaacaactgccgggtttgcctgctcgcaatgtgggcaaccattatttgtttataaattagagcaggtttcggaaaaaggaaaggcttacacaaattacttcggcagatgtaatgttgccgaacacgaaaaactcatattgttagctcagttgaagcctgagaaagactctgatgaggccgttacttactcgttggggaagtttggtcaaagagctctcgatttttattctattcatgtgacaaaggagtccacacatcccgtcaagcccttggcacaaattgcgggtaatagatacgcttcgggtccagttgggaaggccctttctgatgcatgtatgggcacaattgctagctttcttagtaaataccaggatatcataatagagcatcaaaaagttgtaaagggtaaccaaaagagattagaatcgctgcgtgagttggcgggtaaagaaaacttggaatatccatctgtcactctgcctcctcaacctcatactaaggaaggtgtagatgcgtacaatgaagttatcgctagagtccgtatgtgggtgaatttaaatttgtggcaaaaattgaagttatcgcgtgatgatgcaaaacctcttcttagactaaagggctttcctagcttccctgtagtggaaagacgcgaaaatgaagtcgattggtggaatacaattaacgaagtcaaaaaactgatcgatgcaaagcgagatatgggtcgagttttttggtctggtgttacagctgaaaaaaggaatacgatcttagaaggttacaactacttgccaaatgagaacgatcataaaaaaagagaaggcagtttagaaaatccaaaaaagccagctaagagacaatttggtgatttgctactttacctagaaaaaaagtacgccggagattgggggaaagtctttgacgaagcttgggagagaatagataaaaaaatagcaggattgacgtcacacattgaaagagaagaggcgagaaatgcagaagatgctcagtccaaagctgtcctcaccgactggttgagagccaaagcgtcctttgttctcgaacgcctaaaagaaatggatgagaaggaattttatgcctgcgaaatccagctacaaaaatggtacggagacttgagaggtaacccctttgccgtggaagcagagaaccgtgttgtagatatctccggtttctcaatcggtagcgatggacactccattcagtatcgcaacttgttggcctggaaatatttggaaaacggtaagagggaattctatttacttatgaattatggcaagaaaggtagaatcaggtttactgacggaacagacattaaaaagagtggtaagtggcaaggccttttgtacggtggtggcaaggccaaagtaatagacttaacatttgaccccgacgacgaacaactgataatactgcctttagcttttggtactcgacaggggcgagagttcatttggaatgatcttttgtcactcgagactggtttgataaaacttgcaaatggaagagtcatcgagaagacaatttacaacaaaaagataggtcgcgatgagcctgcactatttgtggccttgacctttgagagaagggaagttgtcgacccatccaatattaaaccagtcaacctaatcggtgtagatagaggtgaaaacatcccagctgttatcgctctgacagaccctgaaggttgccctttgccagaatttaaagattcgtctggtggaccaacagatatattacgtattggggaaggctataaagagaaacaacgtgctattcaggctgcaaaagaagttgaacagaggagagctggaggttacagtagaaaattcgccagtaaaagtagaaacttagcagatgacatggttagaaactctgcccgggatttgttctatcatgcggttactcacgatgcagtcttagtctttgaaaatctatcgcgcggttttggtaggcaaggcaagaggacttttatgacagagagacaatatacaaaaatggaagattggttaaccgcgaagctcgcatatgaaggtcttacttcgaaaacgtacctcagcaaaacgctggctcaatatacttctaaaacttgttcaaattgtggttttactattaccacggcagactacgacgggatgttggtgagattgaagaagacgagcgatggttgggcaacaacattgaataataaggaattaaaagcagaaggacagattacgtattacaatcgttataaacgccaaacggttgagaaagagttgtcagccgagttggatagactaagtgaagagagcggtaacaatgatatctcaaagtggactaaagggaggcgggatgaagccctctttttactaaagaagagattctcacatagacctgtgcaagaacaattcgtttgtttagattgtggccatgaggttcatgcagacgaacaggctgcgttaaatattgcgagaagctggctatttctaaattctaattcaacagagttcaagagctataaatccggaaaacaacctttcgtaggcgcgtggcaagccttctataaaaggagattaaaagaggtttggaaaccaaatgca

SEQ ID NO: 146 - DNA, 2919 bp, Artificial Sequence
  Description of Artificial Sequence: Synthetic polynucleotide
atgaaaagaattaacaaaattagaaggaggctggtcaaagattctaataccaagaaagctggtaagactggtccgatgaaaaccctattagtcagagttatgaccccagatttgagagaaagattggagaacctcaggaaaaagcccgaaaacatcccacaacccattagtaacacatcaagagctaatttaaacaagttattaactgactacactgaaatgaaaaaagcaatattgcatgtttactgggaagagttccagaaagatcctgttgggttgatgtctagagttgctcaaccggccccaaagaatatagatcaaaggaaacttattcctgtgaaggacggcaatgaaagattaaccagctccggtttcgcttgctcccagtgctgccaacccctgtatgtatacaaactggaacaagtaaatgataaaggtaagccacatactaactactttggtaggtgtaatgtatccgagcatgaaagattgatcttgttaagtccccataaaccagaagctaatgatgagttagtaacttatagtttaggtaagttcggacaacgagctttagatttctatagcatccatgttacaagagaaagcaatcaccccgtcaaaccactggaacaaatcggtggtaatagttgtgcgtcaggtccagtaggcaaagctttatcagacgcttgcatgggtgccgtggctagttttttgacgaaataccaagatattatactggaacatcaaaaggtaattaaaaagaatgaaaagagactcgctaacttaaaagatattgcaagtgccaatggtttagcttttcctaaaattaccttgccacctcagccacatacaaaggagggaattgaagcttacaataatgtagtagcccaaatagttatttgggtgaaccttaacctatggcaaaagttaaaaattggtagagacgaagccaaacccctgcagaggctgaagggttttccctccttccccttagtagagagacaagctaatgaagtggactggtgggatatggtgtgcaatgttaaaaaattgattaatgagaagaaagaggatggtaaagtgttttggcagaatcttgctggctacaagagacaggaagctttactgccttatttatcttctgaggaagataggaaaaaaggtaaaaaatttgctagatatcaattcggagacctacttctgcatttagaaaaaaaacatggcgaagattggggtaaagtttatgatgaagcctgggaaagaattgataagaaggtagaaggtctctccaaacatattaaattagaggaagaacgtaggtccgaagacgctcaatcaaaggcagcattaactgattggttgagagcaaaagcctctttcgttattgaaggattaaaagaagccgacaaagatgaattttgtagatgtgagttaaagttgcaaaagtggtatggagacctccgtggtaaaccttttgctattgaggctgaaaattctatactcgatatctctggattttcaaaacaatataactgcgcatttatatggcagaaagatggtgttaaaaagctaaatctatacttaattatcaattactttaaaggtggtaaattgcgttttaagaagataaagcctgaagcctttgaggcaaaccgtttttacactgttatcaataaaaaatctggggaaatcgtaccaatggaagttaatttcaatttcgatgatcctaatcttattattttacctcttgctttcggcaaaaggcaaggtagggagtttatttggaatgatttattgtcgctggaaacggggtctctcaaactcgcaaacggtagggtgatagaaaaaacattatacaacaggagaactcggcaggatgagccagctctttttgtggctctgacattcgagagaagggaagttttagattcatctaacatcaaaccaatgaatttaataggtattgaccggggtgaaaatatacctgcagttattgctttaactgatcctgagggatgtcctcttagcagattcaaggactcgttgggtaaccctactcacatcttaaggattggagaaagttacaaggagaaacaaaggacaatacaagctgctaaagaagtagaacaaaggagggcgggtggatatagtcggaaatatgccagcaaggccaagaatttagctgacgacatggttaggaatacagctagagaccttttatactatgccgtcacccaggatgccatgttgatatttgaaaatttaagtagaggcttcggtagacaaggtaagcgcaccttcatggcagagagacaatatactagaatggaagattggttgactgccaaattggcatacgaaggtctacctagtaagacgtacttatctaaaacactagcgcagtatacttccaagacatgcagtaattgtggtttcacaatcacttctgccgattacgatcgcgtcttggaaaaactaaaaaaaacagcgacaggttggatgactactattaatgggaaagaattgaaggtcgaaggacaaataacttactataatagatataaacggcaaaacgttgtaaaagacctgtcagtcgaactcgatcgacttagtgaagaatctgttaataatgatattagttcgtggacaaaaggtagatccggtgaagctttgagcctcctgaaaaaacgttttagccataggcctgtccaagaaaagtttgtatgtttaaactgtggttttgagacccatgcagacgagcaggccgctcttaatattgctagatcatggttatttttaagatctcaggaatacaagaagtaccagactaacaagacaacaggcaacacagataagcgagcattcgttgagacttggcaatctttttatagaaagaaattgaaggaagtctggaaacca

SEQ ID NO: 147 - DNA, 4077 bp, Artificial Sequence
  Description of Artificial Sequence: Synthetic polynucleotide
atgggaaaaatgtattatctaggcctggacatagggaccaattcagtaggctacgctgtcactgacccctcctaccatttgctgaagttcaagggggaacccatgtggggagcacacgtgtttgcggccggcaaccagagcgcagagcggagaagcttccgcacctccaggagaaggctggatcgcaggcagcagcgtgtgaagctggtccaagagatatttgccccagtgatttcccccatcgatccgcgcttctttattaggctccacgagtccgctctctggcgcgacgacgtggccgaaactgataaacatattttctttaatgacccaacatacactgacaaggagtactattcagattacccaacaattcaccatttgatcgtggaccttatggaaagttcggagaagcatgatcctcgacttgtctatttggccgtggcgtggctcgtggcacataggggccacttcttgaacgaggtggacaaggataacatcggggatgtgttatctttcgacgctttctatcctgaattccttgcttttctgtctgacaatggcgtcagcccgtgggtctgcgaatccaaggccctccaggctacgctattgtcaagaaatagcgtgaacgacaagtacaaggctcttaagtctttgatttttggaagccagaagcccgaggacaactttgatgcaaatatctcggaggacgggctgattcagctcctcgctgggaaaaaggtcaaggtcaataagctgtttccacaggagtcaaatgacgcgagcttcacccttaacgacaaagaggatgccattgaagagatcctggggacactcaccccagacgagtgcgagtggatagcccatattaggcgcctctttgattgggccataatgaaacatgcgcttaaggacgggcgcacgatatccgaaagcaaggtcaaattgtacgagcagcaccaccatgatctgacccagctaaaatattttgtaaaaacatatctggccaaggagtacgatgatatcttccgcaacgtggatagtgagaccaccaaaaactacgtcgcgtactcataccacgtgaaagaagttaagggcacgctgcctaagaacaaggcaacacaagaggagttctgcaagtacgttctcgggaaagttaaaaatatagagtgcagcgaggccgacaaagtggattttgacgagatgattcaacgcctgaccgacaattcgtttatgcctaaacaggtgagtggagagaatcgcgtgattccatatcagctctattactatgaactcaagactattctgaataaggccgctagctatttacccttccttacgcagtgcgggaaggatgccatttctaaccaggataaactcttgagtataatgacatttcgaattccctatttcgtgggtccgcttcgtaaggataacagtgagcacgcttggctggagcggaaggctggcaaaatttatccatggaatttcaacgacaaggtggatctggacaaatccgaagaagcctttatccgcaggatgaccaatacttgcacatactatcctggggaggatgtccttccactggactctctgatctacgaaaagttcatgattttgaatgaaattaacaacataaggatcgatgggtatcctatttccgtcgacgtgaagcagcaggtgttcgggctctttgagaagaagcgacgggtgaccgtgaaggatattcagaatcttctcttatcgctgggagccctggataaacacggaaaactgaccgggatagatactacgattcattctaattacaacacgtatcaccattttaagtcactgatggagaggggcgtcctaacaagagatgacgtggagagaatagtggaacgaatgacatattctgatgacaccaagagagtgcggctttggctgaataacaactacggcactctgacggcggatgatgtaaagcatatttcccgactccgtaagcatgacttcgggcggctgtctaagatgtttctaacaggcctcaagggtgtgcataaggaaactggggagcgcgctagcatcctggattttatgtggaacaccaatgataacctgatgcagctcctgtcagaatgctacacattttcggacgaaatcaccaagctgcaggaggcttactatgccaaggcccaactaagcttgaatgatttcctggattctatgtacatcagcaacgccgtaaaacgaccaatttataggacactggcagtggttaacgacattaggaaagcatgcggaacagctcccaagcgaatctttatcgagatggcccgcgacggcgagagtaagaagaaaaggtcagtgactaggcgggagcagatcaagaacctttaccgctctatccgaaaagacttccagcaagaggttgatttccttgagaagatcttagagaacaagtcagatggacagctccaatccgatgctctgtatctgtacttcgctcagctgggacgagatatgtacactggcgaccccattaaactagaacatatcaaggaccaatcgttttataatatcgaccacatctaccctcagtccatggtgaaagacgatagtctggacaataaggtgctcgtccaaagtgagattaacggagaaaagtcgagcagatatcctttggacgctgcgatccgcaacaagatgaagcccctgtgggatgcttactacaatcatggactgatcagcctgaagaagtatcagagactgacccggagtacccctttcacagacgatgagaagtgggattttatcaatagacaactggtggaaaccaggcagtccacgaaagctctggccattcttctgaagagaaagtttccagacacagagatcgtctattcaaaggccggcctcagttccgactttagacatgagttcggactcgttaaatcacgaaatataaacgatctccaccatgcaaaggacgcattcctcgcgattgtgactggaaatgtctatcacgaaagatttaataggcggtggttcatggttaaccagccatactcagtgaagaccaagacccttttcactcactctattaaaaatggcaacttcgtggcttggaatggtgaggaggatcttggaagaattgtgaagatgttaaaacagaataagaataccatccactttactagattcagctttgaccgaaaagaggggctattcgatattcaaccgttaaaggcttcaacaggtctcgttccacgaaaggccggactggacgtagtgaaatacggcggctatgataagagcaccgcagcttactacctccttgtgcgatttacgctcgaggataagaagacccaacacaagctgatgatgattcccgtggagggactgtacaaagctcgaattgaccatgataaagagtttctcacagattacgcacaaaccaccatctctgagattctccagaaagacaaacaaaaagttataaacataatgtttccaatgggtacaaggcatattaaactgaacagcatgatctccattgatggcttttatttgtccattggaggaaagtctagtaaaggcaagtctgtcctctgccatgccatggtacccctaatcgtcccacacaagattgaatgctacatcaaggctatggagagttttgctcggaaatttaaagagaataataagctgcgtattgtggaaaaattcgacaagataaccgttgaagacaatctgaatctgtacgagctctttctgcagaagctgcagcataacccctataataagttcttctccacacagttcgatgtactgaccaacgggcgatcaactttcacaaagctaagtcctgaggaacaggtgcaaacactcctaaacattctttccatttttaagacctgcagatcttcaggatgcgacttgaagagcattaacgggagcgcacaggcagctaggatcatgatctcagctgacctgacagggctgagtaaaaaatactccgacattcggcttgtagagcaaagcgccagtgggttgttcgttagtaagtcgcagaacctgctggaatacctgtaa

SEQ ID NO: 148 - DNA, 4005 bp, Artificial Sequence
  Description of Artificial Sequence: Synthetic polynucleotide
atgtcttctttgacgaagtttacaaacaaatactctaagcagcttacaattaagaacgaactgattcccgtaggaaagactctggaaaacatcaaagagaatgggctgatagacggcgacgaacaactgaatgagaactatcagaaggccaaaattatcgtggatgacttcctgagggattttattaacaaggccctgaataatacccagatcggcaattggcgggaactggccgacgctctgaacaaagaagatgaggacaatatcgaaaaattacaagacaaaatcaggggcattattgtcagtaagttcgagacattcgatctgttctcttcgtactccattaagaaggacgagaaaatcatcgatgatgacaatgacgttgaggaagaagaactggacttgggtaaaaagacctcatccttcaagtatatttttaaaaaaaatctgtttaaattagtgctccccagttatttaaagacaactaaccaggacaagcttaagattatctcctcttttgacaactttagcacctattttagaggcttctttgaaaatcgcaagaatattttcactaagaagcccataagcacctctattgcctacagaatcgtacatgataacttcccaaaatttttggataacattagatgttttaatgtatggcagaccgaatgtcctcagttaattgtgaaggcggataactacctcaaatccaagaatgtgatcgccaaagataagtctcttgctaactactttacggtcggagcctacgattacttcttatctcaaaacggtattgacttttacaataacattatcgggggattgcctgccttcgccggccatgagaaaattcagggcttaaacgagttcataaatcaggaatgtcaaaaggactcagagctgaaatcaaagcttaagaatcgacacgcatttaaaatggcggtcttgttcaaacagatcctcagcgatagagagaaaagcttcgttattgatgaattcgagagcgacgcacaggtgattgatgccgtgaagaacttctatgcggaacagtgtaaagacaataatgttattttcaacctattaaacttgattaagaatatcgcgtttttaagtgacgatgaactcgacggtatctttatagaaggcaagtacctgtcctctgtcagccaaaaactctactcagattggtccaagctaagaaatgacatcgaggacagtgctaacagcaaacagggcaataaagagctggcaaagaaaatcaagactaataaaggggatgtggagaaggcgatatctaaatatgagttctccctctccgaactgaactccatcgtccacgataataccaagtttagtgatctgttgtcgtgtacactgcacaaagtggccagtgaaaaactcgtcaaggtgaacgaaggcgattggcccaaacacctgaaaaataatgaggagaaacagaagatcaaagaacctttggatgcgttgctcgaaatatataacacactgttgatcttcaactgtaaaagcttcaacaagaacgggaacttttatgtagactacgatcgatgtataaatgaactgagcagcgtcgtttacctgtacaacaagactcgcaattattgtacgaaaaaaccatataacaccgataagttcaagcttaatttcaacagtccccagctgggagaagggttcagcaaatcaaaagaaaacgattgcctgacattactctttaaaaaggatgataattattatgttgggattattaggaaaggcgctaagatcaactttgacgacacacaggccatagctgacaacactgataactgcatctttaaaatgaattactttctgttgaaggacgccaaaaaattcattccaaaatgctctattcagctcaaggaggttaaggcccatttcaagaagtctgaagatgactacatcctctctgacaaggaaaaattcgctagtcctctggttatcaaaaaaagtaccttcttgctggctacagctcacgtgaaaggcaagaaagggaacattaagaagttccaaaaggaatacagcaaagagaatccaaccgagtacagaaattctctgaacgaatggatcgcattctgtaaagaatttctaaagacgtacaaggccgctaccattttcgatattaccaccttgaaaaaagccgaggagtacgccgacatcgtcgaattctataaagacgtggataacctgtgttacaaattggaattctgcccaattaagacctctttcattgaaaacctcatcgacaatggggacctctacttatttagaattaacaataaggatttttcttcgaaatctaccggaactaaaaatctgcacacactgtatctgcaagcaatcttcgatgaacgtaatctcaacaaccctacaataatgctgaacggcggtgctgaactgttctaccgtaaagagagtattgaacagaagaatcgaatcacacacaaagcgggcagtattctcgtcaataaggtgtgcaaagacgggaccagcctggacgataagatcaggaatgaaatatatcagtatgagaacaagtttatcgacaccttgtcggatgaggcaaagaaggtgctacctaacgttatcaagaaggaagctacccatgacataaccaaggataagcggttcacttctgacaagttcttcttccactgtcctctgaccattaactacaaggaaggagacactaaacaattcaataatgaagtacttagctttttgcggggtaatcccgatattaacataattggtatcgaccggggagaacggaacctgatatacgtgacagtaattaatcagaaaggagaaatcctggattccgtatccttcaataccgtgactaataaatctagtaaaatcgagcagacggtcgactacgaggaaaagttagcagtcagagagaaggagagaatcgaggccaaacgttcctgggatagtatcagcaagattgctactctgaaagaaggatatctgtccgctatcgtccatgagatctgtttgttgatgatcaagcacaatgctatagtggttctggagaacctgaacgcaggcttcaagcgaattagagggggcctgtcggaaaaaagcgtttaccagaagtttgaaaagatgctaatcaataagttaaattactttgtaagtaaaaaagaaagcgattggaataagccatcaggacttttaaacgggctgcaactgagcgaccagtttgagtcattcgaaaaactgggtattcagagtggtttcatattctacgtacctgccgcttacacttcaaagatcgatcctacaactggttttgcgaatgtcctgaatctgtctaaggtgaggaatgtggacgcaatcaagtctttcttcagcaacttcaacgagatatcttacagcaagaaagaggctctgtttaaattcagttttgatctggatagcctgagcaagaaaggattctcttctttcgtaaagttttctaagtccaaatggaacgtctacacgttcggagagagaatcattaaaccaaagaacaagcaggggtatcgggaagacaaaaggatcaatctgactttcgaaatgaagaaactattgaatgagtacaaagtctcattcgatttggagaacaatctgatccccaatctgaccagcgctaacctcaaagacacattctggaaggagctgtttttcatctttaagaccaccctgcagctacggaatagtgtcacaaatgggaaagaggatgtactgatctcacctgtgaaaaacgccaagggggagttctttgtgtccggcacccataacaaaaccctgcctcaggactgtgacgcgaacggggcctaccacatcgcgctaaaggggttaatgattctcgaacgtaataatctggtgcgcgaagaaaaagacacaaagaaaattatggccatcagcaacgttgactggtttgagtacgtgcagaagcgtcgaggagttttgtaa

SEQ ID NO: 149 - DNA, 3717 bp, Artificial Sequence
  Description of Artificial Sequence: Synthetic polynucleotide
atgaacaactatgacgagttcactaaactttaccccattcagaaaaccatcagatttgaactgaagcctcagggtcgtaccatggaacacttggaaactttcaactttttcgaggaggacagggatagagctgagaaatacaagatcttgaaagaggccatcgacgagtatcacaaaaaattcatcgatgagcatctcaccaacatgtcgctggattggaacagtctcaagcagatttccgagaagtactataaatctcgggaggagaaagataaaaaggtgtttttgagcgagcaaaagcgaatgcgacaggagatagtctctgaatttaagaaagatgatcggtttaaagacctattttccaaaaagcttttttcagagctgctgaaggaagagatctataaaaaaggcaatcaccaagaaattgatgccctgaaatcattcgacaaattcagtgggtatttcataggactgcatgagaaccggaagaatatgtatagtgatggagacgagatcacagccataagcaatcgaatcgttaacgagaatttcccgaagttcctggataacctgcagaagtatcaagaggctaggaaaaagtaccctgagtggatcatcaaggctgaatcagctctggtggctcacaatatcaagatggatgaagtctttagtcttgagtactttaataaagtccttaaccaggagggcatccagcgctataacctggctctcggtggctacgtcacaaaaagcggagaaaagatgatgggtctcaacgatgcactgaatttggctcatcagtcggagaagtcatctaagggacgcatacacatgacaccactgtttaaacaaatcctgagcgaaaaggaatcattttcctacattcccgacgtattcaccgaggactcacaactgctgcctagtataggggggtttttcgctcagatagagaacgacaaagatggcaacatttttgacagagccttggagttgatttcatcttacgccgagtacgatacggagcgcatttatattcgccaggcggatatcaacagggtttccaatgtgatctttggcgagtggggaacgctgggcgggctgatgcgggaatacaaagccgactcgatcaatgacatcaacctggagagaacatgcaagaaggtcgataaatggttggatagcaaagagttcgccctgagtgacgtcttggaagctatcaaaagaaccggaaataatgacgcgttcaacgagtatatctctaaaatgaggaccgcgagagaaaaaattgatgcagcaaggaaggagatgaagtttatatctgagaagatctcaggcgatgaagagtccatccatattattaaaactcttctggactcagtgcagcaattcctgcacttttttaacctcttcaaggccaggcaggatataccgttagacggggctttttatgccgagtttgatgaagttcattcgaaactttttgctatagtgcctctctataataaagttcgcaattacctgacaaagaataacttaaacacaaagaaaatcaagctcaacttcaaaaacccaacactggcaaacggatgggatcagaacaaggtatatgattacgcctcattgattttcctccgggacgggaattactatctggggatcatcaaccctaagcgcaaaaagaacattaagttcgaacagggatctggcaatggtcccttctataggaaaatggtatacaaacagattcctggccccaacaagaatctcccacgcgtctttctgacgtccactaagggaaagaaggagtacaagccgtctaaagaaattatcgagggctatgaggcagacaagcatattaggggtgacaagtttgacctagacttttgtcataagcttatcgactttttcaaggagtccatagagaagcacaaagattggtcaaagtttaatttctatttttctccaacagagtcctacggggatatctctgagttctatctggatgttgaaaagcaggggtacagaatgcacttcgaaaatatctcagcagaaactatcgatgagtacgtagagaaaggagatctgtttcttttccaaatctacaataaggattttgtgaaggccgccactgggaagaaggacatgcacactatttactggaacgctgcattttcccctgaaaatctgcaggacgtagtagtgaaattaaatggtgaggcagaactgttttaccgcgataaatcagacatcaaggaaatagtgcaccgggaaggcgagattcttgttaaccgaacatataatggcaggacacctgtccctgataaaattcataagaaactgaccgattaccacaacggtcgaaccaaggatctgggcgaggccaaggaatacctcgataaggtgaggtacttcaaagcccattatgacatcaccaaggaccgaagataccttaacgacaaaatctacttccatgtcccactcaccttgaacttcaaagctaacggtaagaagaacctcaataaaatggtgattgaaaaatttctgtccgatgagaaggcccatatcatcggcattgatcgcggcgagagaaatctcctttactattctatcattgatcggtcgggaaagattatcgaccaacaatcactgaatgtcatcgacggattcgactatagagagaagctgaaccaacgggaaatcgagatgaaggacgcgcgccagtcctggaacgctatcggcaaaattaaagatttgaaagaaggttacctctccaaagcagtgcacgaaattaccaaaatggcaatccagtacaatgctattgtggtaatggaggagttaaattacggatttaagcgcgggaggttcaaggttgaaaagcaaatttaccaaaaatttgagaacatgttgattgataagatgaactacctggtgttcaaggacgcacctgacgagtcgccaggcggcgtgttaaatgcatatcagctgacaaatccactggagagctttgccaagctaggaaagcagactggcattctcttttacgtccctgcagcgtatacatccaaaattgaccccaccactggcttcgtcaatctgtttaacacctcctccaaaaccaacgcacaagaacggaaagaatttttgcaaaagtttgagtccattagctactctgccaaagacggcgggatctttgctttcgcattcgactacaggaaattcgggacgagtaagacagaccacaagaacgtctggaccgcgtacactaatggggaacgcatgcgctacatcaaagagaaaaagaggaatgaactttttgacccttcaaaggaaatcaaggaagctctcacctcaagcggtatcaaatacgatggcgggcagaatattttgccagatatcctcagatcgaacaataatggacttatctatactatgtactcctccttcattgcagcaattcaaatgagagtgtacgatggaaaggaggattacattatatcgccaattaagaactccaaaggcgaattcttccgcacggatcctaagcgaagagaactcccaatcgacgctgatgcgaacggcgcctataatatagccctgcggggtgaattaacaatgcgcgctattgccgagaagttcgaccccgattcagaaaaaatggctaagcttgagctgaaacacaaagattggttcgaattcatgcagacaagaggcgactaa

SEQ ID NO: 150 - DNA, 3897 bp, Artificial Sequence
  Description of Artificial Sequence: Synthetic polynucleotide
atgactaagaccttcgattccgagttcttcaacctttattccctgcagaaaactgtaaggtttgagctgaagccggtgggcgagacagccagcttcgtagaggatttcaagaatgagggtctcaaacgggtagttagtgaggatgagaggagagcagtggactatcagaaggtgaaagagatcatcgatgactatcaccgggatttcatagaggagtcgttgaattacttccctgagcaagtatccaaagacgcgctggaacaggcctttcatctttaccagaaactgaaggcagcgaaggttgaggagcgggaaaaggccttgaaagagtgggaagccctgcagaaaaagctcagagaaaaggttgtcaaatgcttcagcgacagcaacaaagccaggttcagtaggatcgataagaaagaactgatcaaagaagacttgatcaattggctggttgcacagaaccgggaagatgatattcccaccgtagagaccttcaacaacttcacaacttacttcaccggcttccatgagaatcgtaaaaacatctacagtaaagatgatcatgcaaccgccatctccttccggttgatccacgagaatctccccaagttctttgacaacgtgataagtttcaataagttgaaagagggatttcccgaactcaagttcgataaagtgaaggaggatctggaagtggattatgaccttaagcacgctttcgagatagagtacttcgtgaactttgtgactcaggccggcatcgatcagtataactacctcctcgggggtaagacgctcgaggacggtactaagaagcaaggaatgaatgagcaaattaatctatttaaacagcagcagaccagggataaggctagacagatccccaagcttattcctctttttaaacagatcctaagtgaaaggacagaaagtcaaagcttcatacctaagcaatttgaaagtgatcaggagctgtttgactccctgcaaaagctgcacaacaattgccaggacaagtttaccgtgctgcagcaggctatcctcggactggctgaggcggatcttaagaaggtattcattaagactagcgacctcaatgcccttagtaacaccatctttggaaattactccgttttcagcgatgccctcaatctatacaaagagagcttgaagactaaaaaagctcaggaagcttttgaaaaattaccggcacattctatacacgaccttatacaatacttagagcagttcaacagcagcctcgacgctgagaaacagcaatccacagacaccgtcctgaattacttcatcaaaaccgatgaactgtactcccgatttatcaagagcacttcagaagccttcacgcaagttcagcctctgttcgagctggaggcactgtccagcaagagacgaccgccagagtctgaagacgagggagccaagggtcaagaggggtttgaacagataaagcgaattaaggcttacttggatactctcatggaggcggtgcatttcgctaagcctttgtacctggttaaaggccgaaaaatgattgaggggctagataaggatcagtctttttacgaggcttttgaaatggcctaccaggaattggaatccttgatcattccaatctataataaagcccggagttatctgagcaggaagcccttcaaagccgacaagttcaaaataaattttgacaataatacgctactgtctggttgggacgctaacaaggaaacagccaatgcttccatcctgtttaagaaagacggcctgtactacctgggaattatgccaaaaggcaaaacttttttgttcgattactttgtgtcatcagaggatagcgagaagttaaagcaaagacggcagaagaccgccgaagaagccctcgcacaagacggagaatcatatttcgagaaaattcgatataagctcctgcctggcgcatcaaagatgttgccaaaagtcttcttttccaacaaaaacatcggcttttataaccccagcgatgatatccttcgcatccggaacaccgcctcacataccaaaaatggaactccacagaagggccactcgaaggttgaattcaaccttaacgattgtcacaaaatgattgatttttttaagagctccattcagaaacaccccgaatgggggtcctttggcttcaccttttctgatacttcagacttcgaggacatgtccgccttctacagggaggtggagaaccagggctatgtcatctccttcgacaaaataaaagagacatacattcagagccaggtcgagcagggaaatctgtacctgtttcagatctataacaaggatttcagtccctatagcaagggcaagcccaatttacataccctgtactggaaggccctgttcgaagaggcaaaccttaacaatgtagttgctaagctgaatggggaagcagagatcttcttccgaaggcacagcatcaaggcaagcgacaaagttgtacatcctgctaaccaggccatcgataacaagaacccgcatacagaaaagacacagtcaacctttgaatacgacctcgtgaaggacaagaggtacacacaagataaattcttcttccacgtgcccatcagcttgaattttaaagcgcagggagtgagcaaatttaacgacaaggtcaacggcttcctgaagggaaaccccgacgtgaatatcatcggaattgatcgcggtgaaagacatctcctctactttactgtggtgaaccagaagggtgagatcctagtacaggagagcctgaacacccttatgagtgataagggccatgtgaatgattaccagcagaagctggacaagaaggaacaggaaagggacgcagcgcggaagtcctggaccactgttgagaatatcaaagaactgaaggagggatatcttagccatgtggtacacaaacttgcacatctgattatcaagtataatgccatagtctgcctggaagacttgaacttcggtttcaagcgaggaaggtttaaagtggagaagcaggtgtaccagaagtttgagaaagcccttattgataagctaaactaccttgtctttaaggaaaaagaactcggcgaagttggccactatttaaccgcctaccaactaaccgcccctttcgagtcttttaagaaactgggaaagcagagcggaatactcttctatgtgcctgcagactacacctctaagatcgaccccactaccggctttgtaaactttctagatctccgctatcagtcagtagaaaaagccaaacagctcttgtcagattttaacgccatccgatttaattccgtccaaaattacttcgagttcgaaatcgactataaaaaacttacccccaagagaaaggttgggacgcagtctaagtgggtaatctgcacttacggtgacgtgagataccagaaccgccgaaaccagaaaggtcattgggaaaccgaggaagtgaatgtgactgagaagctcaaggccctcttcgctagcgacagtaaaacaacaacagttatcgattacgccaatgacgataatcttatagacgtgatcttggaacaagacaaagcctctttttttaaggaattgttgtggttgctgaaacttacaatgacccttaggcacagcaagatcaaatcagaggatgacttcatcctcagcccggtgaagaatgaacagggagagttctacgattcacggaaggctggagaggtgtggcccaaggatgccgacgcgaacggggcctaccacatagctctaaaaggtctgtggaacctgcaacaaatcaatcaatgggagaaaggtaagacactgaacctggccatcaaaaatcaagattggttctcattcatccaggaaaagccttatcaagagtga

SEQ ID NO: 151 - DNA, 3708 bp, Artificial Sequence
  Description of Artificial Sequence: Synthetic polynucleotide
atgcatacgggaggccttttatcaatggacgcaaaagagttcaccgggcagtatccattatctaagacactccgcttcgagctgaggcccattggcaggacctgggacaacctggaggcgtcgggctacctggctgaggacagacatcgcgcagaatgctatccgagagctaaggagcttttggacgacaatcatcgcgcgttccttaaccgggtgctcccacagatcgatatggactggcacccgatcgctgaggctttttgcaaggtccataagaaccctgggaacaaagagctcgcccaggactacaacttgcagctgagcaagcgacggaaagagatttctgcctaccttcaagacgccgatggctacaaagggctcttcgcaaagcccgcattggatgaggccatgaaaatcgccaaggagaacgggaatgaaagtgacatcgaagttctcgaagcgtttaacggatttagcgtgtactttaccggctatcatgagtcaagggagaatatttatagcgatgaggacatggtctctgtggcctaccggattaccgaggataatttcccgaggtttgtttcaaatgcactaatattcgacaagttaaatgagagccacccagacatcatctcggaggtcagcggcaacctcggagttgacgatattggcaaatacttcgacgtgagcaactataacaacttcctctcacaggctggcatcgacgactataatcatattataggcggccacactactgaggatggtctcattcaggcattcaatgtagtcttgaatcttaggcaccagaaggaccctgggtttgaaaagatacagttcaagcagctgtataagcagatattatccgtgcgaacatctaaaagttacatccccaaacagtttgataactcaaaggagatggtggattgcatatgcgattatgtgtcaaaaattgaaaagagcgagactgtggagcgggctctgaagctcgtcaggaacattagctcctttgaccttagaggaattttcgtcaataaaaagaatctgaggatcctgagcaataagctaataggagattgggacgccatagagacagcattgatgcattccagctcaagcgagaatgataagaagtctgtctacgatagcgctgaagccttcacgctggacgatatcttctcttccgtgaaaaaatttagtgatgcgtccgcagaagatatcgggaatcgagccgaagatatctgcagggtaatttcagagaccgcccctttcatcaatgacctgcgcgccgtggacctggatagcctgaatgacgatggttacgaagctgcagtttctaagatcagggagtctctggagccatatatggacttgtttcacgaacttgagatctttagcgtgggcgacgagttcccgaaatgcgcagctttctatagcgagttagaggaggtcagcgagcaattaatcgagatcatacccctgtttaataaggcacggagcttttgtactcgcaagcgctacagcaccgacaagattaaagttaatctgaaatttccaactctcgcagacgggtgggacctaaacaaggaacgcgataataaagccgccatccttagaaaggacggaaagtactatcttgccatcctagatatgaaaaaagatctgagttccattcgtactagcgatgaagacgaatcttctttcgaaaaaatggagtataagctgctcccctcgccagtcaagatgctacccaagatctttgtgaagagcaaagcagccaaggaaaagtacgggctgacggacaggatgctggagtgctacgataagggaatgcataaatcagggtcagcttttgacttgggcttttgccatgagctaatcgattactacaagcgctgtatcgccgagtatccaggatgggacgttttcgactttaaatttcgggagacttctgattatggttcaatgaaggagttcaacgaagatgtcgctggtgccggttactacatgagccttcgcaagattccttgttccgaagtctaccggctactggacgagaaatctatatatttgttccagatatataacaaggactacagtgagaatgcacatgggaataagaatatgcatactatgtattgggaaggtctcttttcaccccaaaatttggagtcacccgtgttcaaacttagcggtggcgcagagctgttctttaggaaatccagtatacccaatgacgccaagacagtccacccaaagggtagcgtcctggtgcccagaaacgatgtgaacggcaggagaatccctgacagcatttaccgagaacttaccaggtacttcaaccgcggcgactgtagaatctctgatgaggcaaagtcttatctggataaggtgaagactaagaaggcagatcatgacattgtgaaagaccgccgctttactgtcgacaaaatgatgtttcacgtgcctatcgcaatgaattttaaggcaatctcaaaaccgaatctgaacaagaaggtgatagatggcattatcgatgaccaggacctcaagatcatcggaatcgacagaggtgagcgaaacctgatatacgtcacaatggtagatcggaagggtaatattctgtaccaggattcactaaacatcctcaatggatatgactatcgaaaagctctcgatgtcagggaatacgacaacaaggaggcgcgacggaattggacaaaggtggaaggcatacggaagatgaaggaaggctatctgtcactagctgtctccaaattggctgatatgattatagagaacaacgccattatcgtgatggaagatctcaaccatggattcaaggcaggaagaagtaaaattgagaagcaggtgtatcagaagttcgaaagcatgcttattaataagttgggttatatggtcttaaaggacaagtctatcgatcagagcggcggcgcactccatgggtatcagctggctaaccatgtcaccacactagcatccgtaggcaaacagtgtggcgtgattttctacattcctgctgcgttcacttctaagatcgatcctaccacgggattcgcagacctgttcgcactgagcaatgttaaaaacgtggcctccatgagggagttctttagcaaaatgaaaagcgtgatttatgacaaggccgagggcaagttcgctttcacatttgactacctggactacaatgtgaaatcagagtgcgggagaaccctgtggaccgtatacacggtaggggaaagattcacttacagtcgagttaatcgggagtatgtccgtaaagtgccaactgacatcatctacgatgcccttcagaaggctggcataagtgttgagggggatctaagggacaggatcgctgaatcggatggcgatactctcaaatcaatcttctacgccttcaagtatgccctcgacatgagggtagagaaccgggaggaggactatatacagtctcccgtgaagaatgcgtcgggagagttcttctgctcaaaaaacgccgggaaatctttgccgcaggattctgatgcaaatggggcttataacattgctctcaaaggcatcctgcagctgcgcatgctatctgaacaatatgacccaaacgctgaaagcattagattgccattgatcaccaataaggcttggctgactttcatgcagagcggtatgaagacatggaaaaactaa

SEQ ID NO: 152 - DNA, 3783 bp, Artificial Sequence
  Description of Artificial Sequence: Synthetic polynucleotide
atggattcccttaaggacttcacaaatctttaccccgtgagtaaaaccctgagatttgaactcaagcccgtgggaaagactctcgagaatatcgagaaggccgggattttgaaggaagacgagcatcgggcggaaagttacagacgggtgaagaagattatagatacttatcacaaggtctttatagacagctctttagagaacatggcaaagatgggcatcgagaacgaaatcaaggccatgctgcagtccttctgcgagctgtataaaaaggatcatcggaccgaaggcgaagacaaggcgctggataagatcagggcagtgctgcgcggcctcattgtgggtgccttcactggggtgtgcgggcggagagagaacactgtgcagaatgagaaatacgagagtttgttcaaagagaaactcatcaaggaaatcctgcccgacttcgtcttaagcacagaagccgaatctctcccattttctgtcgaggaggccacgcgttcccttaaagagttcgacagtttcacttcatactttgccggattttatgaaaaccgtaaaaatatatactccactaaaccacagtcaactgcaatagcttacaggttaatccacgaaaacctgccaaaattcatcgacaatatactcgtctttcaaaaaatcaaggaaccaatcgcgaaggaacttgaacacatccgggctgactttagtgcgggaggatacatcaaaaaagacgagcgcctggaggatatattttcactaaattattatattcatgtactgagccaggctggcatagaaaagtacaacgctctaattgggaaaatcgtgacagaaggtgacggggaaatgaaagggctaaacgaacatattaacttatataaccaacagcggggtcgagaagatcgtctgcccctgttcagacctctgtataagcaaatactctccgacagagagcagctatcatatctgcccgagtcctttgagaaagatgaagagctgctccgggcgctcaaggagttctatgatcatatagccgaggacattttgggcagaactcagcaactcatgacgtctatttctgaatatgatctgtctcgtatctatgtcaggaatgatagccagctgaccgatatatccaagaagatgctgggggactggaacgccatttatatggcgagggagcgagcatacgatcacgagcaggcacccaagagaatcacagccaaatatgagagagaccgcattaaggcgctgaagggcgaagaaagtatcagtctggccaatctgaactcctgcatagctttccttgataacgtgagggattgcagagttgatacttacctgagtaccctgggccagaaggaagggcctcacggcctctctaatctagtggagaatgtatttgcctcctaccacgaagctgagcagctgctgtcatttccgtacccagaggaaaataatttaatacaggataaggacaacgtagtgcttatcaaaaatctactggataacatttccgacctccagcgctttctcaaaccactttgggggatgggcgacgagcctgataaggatgagcgcttttacggcgagtacaactacatcaggggcgccttggaccaggtgattcccctctataataaagtcaggaattacctgacccgaaagccatacagtacaagaaaggtgaaattaaatttcggcaatagtcagctgctgtctggttgggaccgaaataaggagaaagacaacagctgcgtaattctcagaaaaggacagaacttttatttggccatcatgaataacagacacaagagatctttcgagaacaaagtgctccctgagtataaggagggggaaccctacttcgagaagatggactataaattccttcctgatccaaataaaatgctgcctaaagtatttctgtcaaaaaaaggtatagaaatctacaaaccttcacctaagctacttgaacagtatggccacggcacccataaaaaaggggacacgttcagcatggacgacctacacgaactgattgacttctttaagcacagcatagaagctcatgaggactggaaacagttcggattcaaattctcagataccgcgacctacgaaaacgtgtctagtttttaccgggaagtcgaggaccagggctacaagctcagcttcagaaaagttagcgaatcttacgtctactcccttatagatcaaggtaagctgtatctctttcaaatctacaacaaggacttttccccatgtagcaagggcacccccaatctgcacactctctactggcggatgctgttcgacgagcgtaacctggcagacgtgatctacaaattagatggtaaagctgagatcttctttcgtgaaaagagcctaaagaacgatcaccccactcaccccgccggaaagcccattaagaagaaaagtaggcagaagaaaggagaagaatcgctatttgagtacgacctcgtcaaggatcggcattatacaatggataagttccagttccatgtgccaataactatgaatttcaagtgcagtgctggcagtaaggtgaatgacatggtaaacgctcatatccgggaggcaaaggacatgcatgttattggaattgataggggtgagcgtaatctcctctacatctgtgttattgactcccgcggcacaatcctcgatcagatttccttgaatacaattaatgatatagactaccatgacttgcttgagtctcgcgacaaagatagacagcaggagagaagaaattggcagaccatcgaaggcatcaaggaactcaagcaaggctacctttctcaggcagtgcatcgaatagccgagctgatggtggcttataaagccgtcgtggcactagaagacctaaatatgggatttaaacgaggcaggcagaaggtggaatcatccgtataccagcagttcgaaaaacagttgatagacaaactcaattaccttgtagacaagaagaagcggcctgaggacatagggggcctgcttagagcgtatcaatttacagccccattcaagtctttcaaagaaatgggtaaacagaacggttttctgttttacatcccagcgtggaacaccagcaatatagatccaaccactggcttcgtcaatctgtttcatgctcagtatgaaaatgtggacaaggccaaatccttctttcagaaatttgacagcatctcctataacccaaagaaagactggtttgaattcgcctttgactataagaatttcactaagaaggccgagggatcaagaagcatgtggatattgtgcacgcatggctcacgtataaagaactttagaaactcgcaaaaaaacgggcagtgggactcagaagaattcgcactcaccgaggctttcaaatccctcttcgtccggtatgagatcgattacaccgccgatctgaagacggcaatcgtcgacgagaaacagaaagacttctttgtagatctacttaagctctttaagctaaccgttcagatgcgaaacagttggaaagaaaaggatctcgactatctcattagtccagtggctggcgcggatggtagatttttcgatacccgggaaggtaacaagtcccttcccaaagacgccgacgcgaatggtgcctacaatattgcactaaaggggctctgggcgctgcggcaaattagacagacatctgaagggggcaagcttaagctggctatttctaataaagagtggttgcagtttgtgcaggaaaggagttatgagaaggactag

SEQ ID NO: 153 - DNA, 3792 bp, Artificial Sequence
  Description of Artificial Sequence: Synthetic polynucleotide
atgaacaacggcaccaacaacttccagaacttcatcggcatatcgtctctgcagaaaacacttaggaatgccctgattccaactgagacaacacagcagtttattgtgaagaatgggatcatcaaagaggacgaattgcgcggggagaataggcagatcctgaaggacatcatggacgattactacaggggttttatctccgaaacgctgagctcgattgacgatattgactggacgtccctctttgagaagatggaaatccaacttaaaaatggcgataataaagataccctgataaaggaacaaaccgaatatagaaaggctatacacaaaaaattcgcaaatgacgaccgctttaagaacatgttttctgcaaaactgattagcgatattctgcccgagtttgtgattcacaataataactattccgcttcggagaaggaggaaaagactcaggtgattaaactgttttctcggttcgccacttctttcaaagattatttcaaaaatcgcgccaactgtttttccgctgacgacatctcctcctcttcctgccaccggatcgtaaacgacaatgccgagatcttttttagtaacgcccttgtgtatcggaggatagtgaagagcctgtccaatgatgacataaacaaaatttctggcgatatgaaggatagcctcaaagagatgagccttgaagaaatttactcctacgagaagtatggggagttcatcacccaggaggggatttccttctataatgacatctgtggcaaggtgaacagcttcatgaacctgtactgccagaagaataaggaaaacaaaaatctgtacaagcttcagaagttacataagcagatcctgtgtatcgcggatacctcatatgaggttccttataagttcgagagtgatgaagaagtgtaccagtctgtaaatggattcttagacaatatttcgtccaaacatatagtggagagactgagaaagatcggggacaattacaatgggtacaatctcgacaagatttatatcgtgtcgaagttttacgaatctgtgagccagaaaacatacagggattgggaaaccattaataccgcgcttgaaattcactacaataatattctgcctggcaacggaaaaagcaaggccgataaggtaaaaaaggcagtcaaaaatgaccttcagaaaagtatcaccgaaatcaatgagttggtgagcaactacaaattgtgttcagacgataatattaaagcggaaacgtacatacatgaaattagccatattctgaataactttgaggcgcaggaacttaagtacaaccctgaaattcatctcgtcgaaagcgaattgaaggcctctgaattgaaaaacgttcttgacgtgataatgaacgctttccattggtgctctgtgtttatgactgaagagctggttgataaggacaacaacttttatgctgaacttgaggaaatctacgacgagatctaccctgtgattagcttgtataacctcgtcagaaactacgttacccagaagccgtacagcacgaaaaaaataaagctgaactttggtattccgactctcgccgatggatggagcaagtcgaaggaatattccaacaatgccatcattcttatgcgagacaatctgtattacctcggcatctttaacgccaaaaacaagccggataagaaaatcattgaagggaatacgagcgagaataagggcgactataagaaaatgatctacaacttactgccaggtcccaataaaatgattcctaaggtgtttctgtcatcgaaaacaggtgtagaaacatataagcccagcgcatacatcctggaaggctacaagcaaaacaaacacatcaaaagcagcaaggactttgatatcacattctgccacgatctaatcgactacttcaaaaattgcatcgccattcaccctgagtggaagaacttcggctttgacttctccgacaccagtacctacgaagacatttctggattctaccgtgaggttgagctgcagggttataaaattgactggacatacatcagtgaaaaagacatcgatctactgcaggagaaggggcagctctatctcttccagatttataataaggatttcagcaagaagtccactggaaacgacaatctgcatacaatgtatcttaagaacttgtttagcgaagagaatttgaaagatatcgttctaaagttaaacggggaagccgagattttctttcgaaagtcttccattaagaatccaattattcacaagaagggcagtatcctggtcaacagaacctatgaggccgaggaaaaggaccagttcggtaatatacaaattgtgcgcaagaacatccccgagaacatttaccaggagctctataaatacttcaacgacaaaagcgataaggagctttccgacgaggctgccaagctgaaaaacgtggtgggacaccatgaagcagccaccaacatcgtcaaagattatcgttatacatatgacaaatattttctgcacatgcctattacaataaactttaaggcaaacaagaccgggttcatcaatgaccggatactccagtacatcgcaaaagagaaggacctgcatgtgatcggcatcgaccgcggtgaaagaaatctcatttacgtcagcgttatcgacacttgtggaaacattgtggagcagaagtccttcaacattgttaacggctatgactatcagatcaagctcaaacagcaggaaggtgctcgtcagattgcgaggaaagaatggaaagagatcggcaagatcaaggagatcaaagaagggtatctgagcttggtcattcacgagatctccaaaatggtcatcaagtacaacgctattatcgcgatggaagacctctcttacggctttaagaaggggcgctttaaagtggagcgccaggtctatcagaagttcgagactatgcttatcaataagctgaattacttggtctttaaggatatcagtatcaccgagaacggaggactgctgaaaggttaccagctcacatatattcccgataagctcaagaatgtgggccaccaatgcggttgtattttttacgttccagctgcctacacatctaagatcgatcctaccaccggattcgtcaatatatttaaatttaaagatctaaccgttgatgccaagcgtgagtttattaagaaatttgattcaatcaggtacgacagcgaaaagaacctcttctgtttcactttcgactacaacaacttcatcacacaaaatactgtgatgagcaagtcatcatggagcgtttatacttatggtgtaaggataaaaaggcgctttgttaatggaaggttttccaatgaaagcgatacaatagacatcacaaaagacatggagaagacactggagatgacagatattaattggagggacgggcatgaccttagacaggacatcatcgactacgaaatcgtccaacacatttttgagatattcagactcactgtccagatgcgaaacagcctgtcggaactcgaagaccgggactacgatagactgatctccccggtgttaaacgaaaataatattttctacgattctgctaaggcaggagacgctcttcctaaagatgcggacgccaatggcgcttactgtatagcgttgaagggattgtatgagattaaacagatcactgagaattggaaagaagacggtaaattctccagagacaagctgaaaatctccaacaaagactggtttgattttattcaaaataagcgctacctgtaa

SEQ ID NO: 154 - DNA, 3957 bp, Artificial Sequence
  Description of Artificial Sequence: Synthetic polynucleotide
atgacaaacaaatttactaatcagtacagcctgtcaaagaccctccgcttcgaactgattccacaagggaagacccttgaattcatccaggaaaagggtttattatcccaggataaacaacgcgcagaaagctatcaagagatgaagaagacgatcgataaatttcataagtatttcatagatttagccctgagcaacgctaaattgacccacctggaaacctatttggagctgtacaacaagtcagccgagacaaagaaagagcagaagtttaaggacgacctgaaaaaagtacaggacaatttgcgaaaagagatcgtcaagtctttttccgacggagacgccaagtcaatatttgccatcctggacaaaaaggaactcatcactgtggagttggagaagtggtttgagaataatgagcagaaggacatctattttgacgaaaagttcaagacatttactacttacttcaccggatttcaccaaaaccggaagaacatgtactctgttgagccgaactcaaccgccatcgcctaccgccttattcacgaaaatctgccaaagtttctcgagaatgctaaagcctttgagaaaattaagcaggtcgagtcgctccaggtgaactttcgagagctgatgggtgaattcggggacgagggcctgattttcgtgaatgaactcgaagagatgtttcagatcaactactataatgatgtactctcacagaacgggatcactatctacaacagcattatctctggattcactaagaacgatatcaagtataaagggctgaatgaatacatcaacaattataatcagactaaggacaaaaaggacaggctgcctaaattgaaacagctgtataagcagatcctcagtgatagaattagcttgtcatttctcccagatgccttcactgacggaaagcaggtgcttaaggcgatattcgatttctataagatcaacctcctctcttatacaatcgagggccaggaggagtcacagaacctcctgctcctgattcgacaaactattgaaaatctgtcctctttcgatacgcagaagatatacctgaaaaatgacacccatctcactacaatatcccaacaggtattcggagatttctccgtcttcagtacagccctgaattactggtacgagacaaaggtgaaccctaagttcgaaacagagtacagcaaggcgaacgaaaagaagagggagatcctggacaaagccaaagccgttttcaccaagcaagattactttagcatcgcatttctgcaggaagtcctgtctgagtacatactgacactcgatcacacaagcgacatagttaagaagcactcttccaattgtatcgcggactacttcaaaaatcattttgtcgcgaaaaaggagaacgagacagataagaccttcgattttatcgcgaatattaccgcaaagtatcaatgcattcagggtatcttggagaacgccgaccagtacgaagacgagcttaaacaggatcagaagctcatcgacaacctaaagttctttttggacgctatactggaactccttcattttattaagccactacatctgaagagtgagtctatcactgagaaggacactgctttttacgacgttttcgagaattactacgaagcactgtctctgctaacccctctgtataacatggtgagaaactatgtgacacagaaaccttatagtaccgagaagattaagttgaacttcgagaacgcacaattgctgaatgggtgggatgcaaacaaagagggtgattacctcacaacaatcctcaagaaagatggcaattacttcctggccattatggataaaaaacataacaaggcatttcagaaatttcccgaggggaaggaaaattatgaaaagatggtatacaagttgctgcccggggtgaacaaaatgctcccgaaggtgtttttctcgaataagaatatcgcgtactttaacccgtccaaggaactgttggaaaattataaaaaggaaacacacaagaagggggacacttttaatttggagcactgccacacactcattgacttctttaaagatagtctcaacaaacatgaggattggaaatattttgactttcagtttagcgagaccaagtcttatcaggatctgtcgggattttatagggaagttgagcaccagggttacaagataaatttcaagaacatcgatagcgagtacattgacggactggtgaacgaagggaagctgttcctgtttcagatttacagcaaagatttctctcctttctcaaaaggcaagccgaacatgcataccctgtattggaaggccctgttcgaggagcaaaaccttcagaatgtgatttacaagctgaacggtcaggccgagattttttttaggaaggcctctatcaagcccaaaaacatcattctgcacaagaaaaagataaagatcgccaaaaaacacttcattgataaaaagacaaagacttctgagatcgtacctgttcagacaatcaagaatctcaacatgtattatcaggggaagattagcgagaaagagctgacacaggacgatttgaggtacatcgacaacttctctatctttaacgagaagaacaagacaatcgatatcatcaaggacaagcggtttaccgtcgataaattccagttccatgtgcctatcacgatgaatttcaaggccaccggtgggagttatatcaaccagactgtgctggagtatctgcagaacaaccccgaagtaaaaattattggcctggacagaggagagcggcatctggtgtacttgaccctcatcgatcagcagggaaatatcctgaaacaagaatctctgaatactattacggactccaaaatcagcacaccttaccacaagctgcttgataataaagagaatgagagggacttggcccgcaaaaattggggcaccgtcgagaatattaaggaattgaaagaaggatacatctcacaggtggttcacaaaatcgcaaccctgatgttagaagagaacgctattgtggtgatggaggacttaaacttcggatttaaaagaggaagatttaaagtcgagaaacagatttatcagaaactggaaaaaatgctcattgacaaattaaattacctggtgctgaaagataaacagccacaggagctgggtggcctgtataatgctctgcagctgaccaacaagttcgagtcgtttcagaaaatgggcaagcagtcaggcttccttttttacgtgcccgcttggaacacctcaaaaatcgaccctacaacaggctttgtgaattatttctataccaagtatgaaaacgtggacaaggcaaaggcctttttcgagaagtttgaagcaatcaggttcaatgccgagaaaaaatactttgagttcgaggtcaaaaaatatagcgacttcaaccctaaggccgaaggcacgcaacaagcctggacaatatgcacgtatggggagagaattgagactaagcggcagaaggatcagaataacaaattcgtgagcacaccgattaacctgacagagaagatagaggacttcctcggcaagaatcagatcgtgtacggcgacggcaattgcatcaagtcacaaattgcatctaaagatgacaaagcattcttcgaaacactgctgtattggttcaagatgacactccagatgcgaaatagcgaaacaagaacagatattgactacctcatcagccctgtgatgaatgataacggcacgttttacaattcccgggactatgaaaaattagagaacccgacactgccaaaagacgccgacgcaaatggtgcatatcacatcgcaaagaaaggtttgatgctgttgaacaaaattgatcaggctgatctgacaaaaaaggtcgatctgagtatcagtaaccgcgactggttgcagtttgtccagaagaacaaataa

SEQ ID NO: 155 - DNA, 4017 bp, Artificial Sequence
  Description of Artificial Sequence: Synthetic polynucleotide
atggaacaagagtactatctgggcctggacatgggcaccgggagtgtcggatgggcagtcaccgactcagagtaccacgtcctcagaaagcacggtaaggcactttggggagtgcgactcttcgagtccgctagtactgctgaagagaggaggatgtttcgaacttccaggcgcaggctggatcggcgaaactggagaatagagattctccaggagatatttgctgaagagatttcaaagaaggatcctggttttttcctgcgcatgaaagaatctaagtattaccccgaagataaacgcgacatcaacggcaattgtcctgaactgccctatgctctgtttgtcgacgacgatttcaccgacaaagattaccacaagaaattccccaccatataccacctgagaaagatgttgatgaacaccgaggagacacccgacatacgtctggtttacctggctatccatcatatgatgaagcaccgcgggcatttcctgctgtctggagacatcaatgagataaaggaatttggtactacgttctccaagttgttagaaaacattaagaatgaagagttggactggaatcttgaactgggaaaggaagagtatgcagttgtagagtcgattttgaaagataacatgttaaaccggtcaactaagaaaaccaggttaattaaggcactaaaggccaaatcgatatgcgagaaggctgtgctaaatctgctggctggaggcaccgtgaaactgtctgatattttcggcctggaagagctcaatgaaaccgagcggcctaaaatttctttcgccgataacggatacgatgactatattggggaggtggaaaacgagctcggagaacaattctacattattgaaaccgctaaggcagtctatgactgggccgtgctcgtcgagattttaggcaagtacaccagcattagcgaagcaaaggtggctacctatgaaaagcacaaatctgacctccagtttctgaaaaagattgtgcgcaaatacttaacaaaagaagagtacaaggacatctttgtgagcacatcagataagctcaagaattactcagcatacattggaatgacaaagattaacgggaagaaggtggatctccaaagcaaacgttgttcaaaggaggagttttacgatttcataaagaagaacgtgctgaagaaactggagggacaaccggagtacgagtatttaaaggaggagctcgagcgagaaactttcctgcccaagcaagtgaacagagacaatggtgtcattccttaccagattcacttatatgagctgaagaaaatcctggggaacttgagagacaagatagacctcatcaaggaaaatgaagataagttggtccagttgttcgaattcagaatcccatattacgtcggcccgctcaataagatcgacgacggcaaggaaggcaaattcacttgggcggtgcgaaaaagcaacgaaaaaatatacccatggaactttgagaacgtcgttgacatcgaggccagcgccgagaaatttataagacgcatgactaataagtgtacttacctcatgggcgaggatgttctgcccaaggacagcctgctgtattccaagtacatggtgcttaacgagctgaataatgtaaagttagatggtgagaagctcagcgtggagcttaaacagaggctgtacactgatgtgttttgcaagtatcggaaagttaccgttaagaagataaagaattacctgaaatgcgaagggatcatttccggcaacgtggaaattaccggaatcgacggcgattttaaggcgtcgttgaccgcttatcatgatttcaaggagattttaaccggcacggagctcgcgaagaaagacaaggagaacataatcacgaatatagttctgtttggggacgataaaaaacttcttaaaaaacgactcaatcgactgtatccgcagattacccccaaccagctgaagaagatttgcgctctgagctataccgggtggggccggttctctaagaaattcctcgaggagatcacagcaccagacccagagactggtgaggtgtggaatattattacagctctgtgggaatccaataataaccttatgcaattgttgagcaatgaatataggttcatggaggaagtggaaacctacaatatgggcaagcagacaaagaccctatcttacgagaccgttgagaatatgtatgtctccccttcagtgaaacggcaaatctggcaaactttgaagatcgtgaaggagctcgaaaaggtgatgaaagagagcccgaagagggtttttattgaaatggccagagagaaacaggagagcaagagaacagagtctaggaagaagcagctaatcgatttgtataaagcctgcaagaacgaggaaaaagactgggtcaaggagctaggcgatcaggaagaacagaagttgcgctctgataagctgtacttatattatacccagaaaggacggtgcatgtactcaggtgaggtcattgagctgaaagatctgtgggacaatactaagtatgatattgatcacatctaccctcagtcaaaaactatggacgactccctcaacaacagggtgttggttaagaagaaatacaatgctacaaagtccgataaataccctcttaacgaaaacatccggcacgaaagaaagggcttctggaagtccctgctggatgggggttttatcagtaaagaaaagtatgagaggctgatccgaaataccgagctctcccccgaggaactggctggctttatcgaaaggcagatcgtagagactaggcaatctacaaaggcagtcgctgagatcctgaagcaagtgtttcctgagtcagaaatcgtgtacgtcaaagctggcacagtgtcacggttccgaaaggactttgagttgttaaaagttcgggaggtgaatgacctgcaccacgctaaagacgcctatctgaatatcgttgtggggaactcctattatgttaagtttactaagaatgcgtcctggtttattaaggagaacccggggcgcacctataacctgaagaagatgttcacctccggctggaacatagaacggaacggagaagtcgcgtgggaggtgggtaagaaagggaccattgtgaccgtcaaacagattatgaacaaaaacaacatattggtaactcgccaggtgcatgaggccaaagggggcctctttgatcagcagattatgaaaaagggcaaaggacagatcgcaatcaaggaaaccgacgagcgcctggcatccattgagaagtacggaggctacaacaaggcggcaggtgcgtacttcatgctcgtcgagtccaaagataagaaaggcaaaactattagaacaatcgagttcatccctctatatttgaaaaataagatcgaaagtgacgaaagcatcgcccttaacttcttggagaagggccggggcttaaaggaaccaaagattctgctcaagaagatcaagatcgacacactcttcgatgtggatggttttaagatgtggctgtcaggcaggacaggggatcgcttgctgttcaaatgcgcaaatcagttgattctggacgaaaagatcattgtgacgatgaagaagatcgttaaattcattcagcggagacaggaaaacagagaactgaaactctccgataaggatggaattgacaatgaagtcctcatggagatttacaatacctttgtggacaagcttgagaacacagtctatcggatccgactgtccgaacaggcaaagactctgatcgacaaacagaaagaattcgaaagactaagcttagaggacaaaagttcaactctctttgaaattctccacatcttccaatgtcaaagtagtgcagccaacttgaagatgatcgggggtcccggcaaggctggaatcttagtcatgaacaacaacatctccaaatgtaacaaaatctccatcataaaccagtctcccaccggcattttcgagaacgaaattgatttactcaag

SEQ ID NO: 156 - DNA, 3858 bp, Artificial Sequence
  Description of Artificial Sequence: Synthetic polynucleotide
atgaaatctttcgattctttcaccaacctctactcccttagcaaaacccttaagtttgaaatgaggccggtggggaatacacagaagatgcttgacaatgctggcgtctttgaaaaggacaaattaatccagaagaagtatggtaaaacaaagccatattttgaccgattgcatcgggaattcattgaagaggctcttacaggagtagaattgatcggactggacgagaacttccgtaccttagtagactggcagaaggacaagaagaacaacgtggcaatgaaggcctatgagaactcactccagcgccttagaaccgagatcggaaagatctttaatcttaaggcggaagattgggtaaaaaataagtacccgatcctgggactgaaaaacaaaaacacagacatcctgtttgaagaagccgtctttggtatcttgaaggccaggtatggagaggagaaagacacgtttatagaggtagaggagattgataaaacaggcaagagtaagattaatcagatcagtatctttgattcttggaaggggttcacaggctactttaagaagtttttcgaaaccaggaaaaatttctataagaacgatggcacctccacagctatcgcgacacgcatcatagatcagaatctgaaacggttcattgataatctgagcattgttgaatccgtgcgccagaaggtcgacctagctgagactgagaagtctttctctatatcactctcccagttcttctcaatagatttttataataagtgccttctgcaagatggcatagactactataacaagatcatcggcggcgaaactctcaaaaacggtgaaaagctcattggcctgaatgagctcatcaaccaatatagacaaaataacaaggatcagaaaatcccattctttaagctgctagataaacagatcctatcagaaaaaatcctgttcctcgacgaaatcaaaaacgacaccgaactcatcgaggctctctcgcagtttgccaagacggctgaggagaagacgaagattgtgaaaaagctgtttgcagactttgtggagaacaactctaaatacgatttggctcagatttatatctcccaggaagcatttaacacaatctccaataagtggactagcgagactgaaaccttcgccaaatacctgttcgaggccatgaaaagcggcaagctcgccaaatacgagaagaaggacaattcctataagtttcccgatttcatcgcattatctcagatgaagtccgcgctacttagcattagcctggaaggccatttttggaaggagaaatactataagatttccaaattccaagaaaagaccaattgggagcagttcttggctatttttctatacgagttcaactctttgttcagtgacaagatcaacactaaggacggtgagaccaaacaagtggggtactacctcttcgccaaagatcttcataacctgatactgtccgaacagatcgacatacccaaggattcaaaggtgaccatcaaggattttgcggattcggtattgacgatctatcagatggcgaagtatttcgctgtcgagaaaaagcgggcatggctggccgaatacgagttggactccttctatactcaacccgatacagggtacctgcagttttacgataatgcatacgaggatatagtccaggtgtacaataaactcaggaactacctcactaagaaaccatactccgaagaaaaatggaaacttaattttgagaatagtacactggccaatggatgggacaagaacaaggaatcagacaactccgctgtaattctccagaagggtggcaagtattatctgggactgataacaaagggccataacaagattttcgatgaccgttttcaggagaagtttatagtgggcatagagggtggcaagtatgaaaaaatagtctacaagttctttcccgatcaggcgaagatgttccccaaagtatgcttcagtgctaaaggcctcgagtttttccggccatctgaagagatactccgcatctataataacgcagagtttaaaaagggagagacgtactcaatcgactcgatgcagaaactcattgacttctacaaagattgtctcacaaaatacgagggctgggcttgctacacgtttcggcacttgaagccaaccgaggaatatcaaaacaacatcggggagttcttccgtgacgtcgccgaagacggctatagaattgactttcagggcataagtgatcagtatattcacgagaagaatgagaaaggtgagttgcatcttttcgaaatccacaataaagactggaatcttgacaaggctcgcgatggaaaatcaaagactacccagaagaatcttcatacactttacttcgagtccctcttttccaacgacaacgtcgtacagaatttcccaataaaactgaacggccaggccgaaattttttacaggcccaaaaccgaaaaagataaactggaatccaagaaagacaagaagggaaataaggtgatagatcacaaaaggtattccgagaacaagatttttttccacgtacctcttaccctgaacagaacgaagaacgactcttatagattcaatgcccagataaacaactttctcgcaaacaacaaagatatcaatattatcggcgtcgatagaggtgagaagcacttggtatattattctgtgatcacgcaagcatccgatatcttggagtccggttctttgaacgaactgaatggtgtcaactacgccgagaaactcggtaagaaagctgagaatcgggagcaggctagaagggactggcaggacgttcagggtatcaaggacctgaagaagggctacatttctcaggtggttcgaaaactggctgatttggccattaagcacaatgcaatcatcattttagaagatttgaacatgcggtttaaacaagtcaggggggggatagagaaatcaatttaccaacagctggaaaaagctctgattgataaactctcttttttggttgataagggcgaaaagaaccccgagcaagcaggacatctccttaaagcctatcaactgagcgcacctttcgagacattccagaagatgggaaagcaaaccggcatcattttctatacccaggcttcctatacatccaagtctgatccagtgactgggtggagaccccatctctacctcaagtacttttctgccaaaaaagctaaggacgacattgctaagttcacaaaaatcgagttcgtgaacgacaggttcgagctgacttatgacataaaagatttccagcaggccaaggagtacccaaacaagacagtttggaaagtgtgttccaatgtggagaggtttcggtgggacaagaatctgaatcagaataaagggggatatactcactacaccaacattaccgagaacatccaagagttgttcaccaaatacggcatcgacattactaaagatctgctgacacagatctccaccatcgatgagaagcagaacacatctttcttccgggatttcatcttttattttaacttgatctgtcagattagaaataccgacgacagtgagatagctaaaaaaaacgggaaagacgatttcattctctctcccgtggagccgttttttgactcccgcaaagacaatggcaataagcttccggaaaacggggacgataacggcgcctacaacatcgctcgtaagggaatcgttatcctcaataaaataagccagtattccgagaagaacgagaattgtgaaaaaatgaagtggggggacctttacgtcagcaacatcgattgggataactttgtgacacaagccaatgcgagacactag

SEQ ID NO: 157 - DNA, 3465 bp, Artificial Sequence
  Description of Artificial Sequence: Synthetic polynucleotide
atggaaaacttcaaaaacctctaccccatcaacaagaccttgaggtttgagctccggccatatgggaagacactggagaacttcaaaaagtccggtctgctggaaaaggatgcttttaaggctaactctaggaggtctatgcaggccattatcgatgagaaattcaaggagaccatagaggagcgtctgaaatatactgagttttccgagtgtgacctaggaaatatgaccagtaaggacaaaaagatcaccgacaaggcagcgacaaacctgaagaaacaggtgattttaagctttgatgatgagattttcaataactacttgaagccggacaaaaacatcgacgctctgttcaagaatgatccaagcaacccggtcatctctactttcaagggcttcaccacatactttgtaaatttcttcgaaatacggaaacacatcttcaagggagagtcttccggtagcatggcttacagaataatcgatgagaacctaactacatatctaaacaatatcgagaagatcaagaaattgcctgaagaactgaaatctcagcttgagggaatcgatcaaattgacaaactgaacaactataacgagttcatcacccagtccggcattactcattataacgaaattattggagggatttcgaagtctgaaaatgtcaaaattcaaggcattaacgaagggattaatctttactgtcaaaagaataaagtgaagctaccacgcttaactcctctgtataagatgattctctctgatcgggtctctaattcctttgtgctggataccattgaaaatgataccgagttaattgaaatgatctctgatctgataaataagacagagataagtcaggatgttattatgtccgacatccaaaatattttcatcaaatataaacaactcggcaacttgccggggattagctactcatctatagtgaatgctatctgttcggattacgacaataactttggtgacggcaaacgtaaaaaaagctatgagaatgatcgcaaaaaacacctcgagactaacgtgtatagcattaactatatctcagagttactgacagacaccgacgtctccagcaacataaagatgcggtacaaagagctggagcagaattatcaggtatgcaaggaaaatttcaacgccactaactggatgaacatcaaaaacattaagcagtctgagaaaaccaatctgatcaaggaccttcttgacatcctcaagagcatccagcggttttatgatttgtttgacatcgtggatgaagacaaaaatcctagtgctgagttctatacctggctgtctaaaaacgcggagaaactggacttcgagtttaattcagtgtacaacaagagcaggaactacctcacgagaaagcagtactccgataaaaagattaagttgaacttcgatagtcctactctcgccaaggggtgggatgcgaacaaagaaattgataatagcacaattatcatgaggaagttcaacaacgaccggggcgattacgattacttcttggggatctggaataagagcacacctgccaacgaaaagatcatcccattagaggataatggactgtttgaaaaaatgcaatataagctgtatcccgatcctagtaaaatgctgccaaagcaattcctttctaagatctggaaagctaaacatccaactacacccgagtttgataagaagtacaaagaaggtcggcacaagaaggggcctgattttgagaaagagtttctgcacgagttgatcgattgctttaagcatggattggtaaaccacgacgaaaaatatcaggatgtgttcgggttcaatctgcgcaacacggaagactacaactcttatacagagtttctggaggacgtcgaaaggtgcaactataatcttagtttcaataaaatcgctgacacgtctaacttgataaatgatgggaaactctatgtttttcagatctggagcaaggatttcagcatagatagcaagggaacaaaaaacttgaacacaatatactttgaatccctcttctcggaggaaaatatgatcgagaagatgttcaagctctcaggggaagccgaaatattctatcgtccagcaagtttgaattattgtgaagatattatcaagaagggacaccaccacgccgaactgaaggacaaattcgactatcccatcatcaaggacaagcgatatagccaggacaaatttttttttcatgtccccatggttatcaactacaaaagcgagaagttaaactccaaatcacttaacaataggacgaacgaaaatttaggccaattcacgcacatcatcggtatcgaccgcggagagcgacatctcatctacctgaccgtggtggatgtgtccaccggtgagatcgttgagcaaaagcacctggatgaaattataaatacagatacaaaaggcgtcgagcataaaactcattatctcaataaattagaagagaagtccaagacgcgggataatgaaagaaagtcctgggaagcaatcgagacgattaaggagctgaaagaaggctatattagccacgtgatcaatgaaatccagaaattgcaggaaaagtataacgcactgatagtgatggagaacctcaattatgggtttaagaactcgcgtatcaaagtggaaaagcaggtctaccagaaattcgagaccgccctgattaaaaagtttaattacatcattgacaagaaagatcctgaaacctacattcatggataccaactgacgaatccaatcactacactcgataaaattggtaaccagagcggtattgtgttgtacattccggcttggaatacaagcaagattgatccagtcactggtttcgttaacctcctgtatgcagacgatttgaaatacaagaaccaggagcaggctaaaagctttatccagaaaatcgataatatctacttcgaaaatggtgagtttaaatttgatatagatttcagcaaatggaacaaccgctactcaattagcaagacgaaatggacactgacaagctacggaacccggatacagacgttccgaaacccccagaaaaataacaagtgggacagcgccgagtatgacctgaccgaagagtttaaattaatcctgaacatcgatggtactctgaaatctcaggatgtggaaacctataagaaattcatgtctttattcaagctgatgttgcagctgcgaaactccgttactggaacagacattgactacatgattagccctgtgacagataaaactggaacccactttgattcacgggagaatatcaagaacctgcccgccgatgctgatgcgaacggagcttacaacattgctaggaagggcatcatggcaatcgagaatattatgaacggcattagcgaccctctgaagatcagtaatgaggactacctgaagtacattcagaaccaacaagagtaa

SEQ ID NO: 158 - DNA, 3924 bp, Artificial Sequence
  Description of Artificial Sequence: Synthetic polynucleotide
atgacccagtttgagggtttcaccaatctttatcaggtgtcaaaaacactcagatttgagctcatcccacagggtaaaactttaaagcatattcaagagcagggctttatagaggaagacaaagccagaaacgaccattataaggaactaaaaccgatcattgaccgcatctacaaaacctatgccgaccaatgccttcagctcgtccaactcgattgggagaatctgagcgccgctattgacagctacaggaaggagaagaccgaggagactagaaacgccctgatcgaggagcaggcgacctatagaaacgctattcacgattattttatcggccgcaccgacaatttgacagatgccatcaacaagcggcacgccgaaatttataaggggttatttaaggccgagctgttcaatggaaaagtactgaaacagctgggcaccgtaacaaccaccgaacacgagaatgctctgttgaggtccttcgacaagtttactacctactttagcggcttctacgaaaaccgtaaaaacgtgttttccgcggaggatatttcaacagccattcctcataggatcgtgcaggataatttccccaagtttaaggagaactgccatatctttaccagacttatcactgctgtgccaagtttacgagaacacttcgagaatgttaagaaggctataggcatattcgtttccacctccatcgaagaagtattcagttttccattctacaatcagttactcacgcagacccagatagatctctacaatcagctgctcggaggcatttctagagaagcaggcacggaaaagatcaagggcttaaatgaagtactcaatcttgcaattcagaagaacgatgagacagcacacattattgcatctctccctcacagattcattcccctgttcaaacagatcctgtccgatcgcaacacactaagctttatacttgaggagtttaagtcagatgaggaagtgatccagagcttctgtaagtataagactttgctccgtaatgaaaacgtgcttgagacagcagaggctctctttaacgagttgaattccatcgacctgacacacatttttatcagccataaaaagctggaaacgattagctctgccttgtgcgaccactgggacaccctgcgtaacgccctctatgaaaggcgcatttccgagctcaccgggaagatcacaaaaagtgccaaggaaaaagtccagaggtcccttaaacatgaagacatcaacctacaagagatcatctctgcggctgggaaagagctgtcagaagcatttaaacagaagacttccgagatcctgagccacgcacacgccgcattagaccagcccctgcctacaactcttaaaaaacaggaggagaaggagattttaaagagccagctggactcattactcggcctgtatcatctcctggactggttcgccgtggacgaatccaacgaggtggacccagaatttagcgccaggctgacaggaattaaactggaaatggagccaagtttgagcttttacaacaaggctcggaactatgccactaaaaagccctacagcgtggaaaagttcaagctgaattttcagatgccgaccctggcttccgggtgggatgttaataaggaaaagaataatggggctatactgttcgtcaaaaatggtctctactacctgggaatcatgcccaaacagaagggcaggtacaaagccctttcgtttgagccgaccgaaaaaaccagcgaaggctttgataagatgtattacgactatttcccagatgcagccaagatgatcccaaaatgtagcactcagttgaaggcggtaaccgctcactttcagacacacaccactcctatcttgctctccaacaactttattgagccgctggagatcacgaaggaaatctacgaccttaacaacccagagaaggaacccaagaaattccaaacagcttatgctaagaagactggggatcaaaagggctatcgagaggctttgtgtaagtggattgactttacacgggatttcctgagtaagtataccaagaccacatctattgacctgtcctcactgagaccttcctcacaatataaggatctcggagagtattatgccgaactcaaccctctactctatcacatctctttccagaggatcgccgaaaaggaaattatggacgccgtcgagacaggcaagctgtacctcttccagatttacaacaaggatttcgcaaagggccaccacggaaaacccaatttgcacactttgtactggacagggctcttctctcccgaaaatttggccaaaacttcaataaaactgaacgggcaagccgagctgttctatcggcccaagtcacgtatgaagcggatggcccaccggctgggcgagaagatgctcaacaagaaactgaaggatcagaagacgcccataccagacactctttaccaagagctgtatgactacgtgaatcacagactgagtcacgacctgtctgatgaagcccgggctcttcttccaaatgtgattaccaaagaagtttcccacgaaattatcaaggaccggcgcttcacctctgacaaattctttttccacgtcccaatcaccctcaactaccaggcagccaattccccttcaaagtttaaccagcgtgtgaatgcctacctgaaagagcatccggagacccccatcatagggatagacagaggagagcggaatcttatctacattactgtgattgacagcacaggtaagatcttggagcagagatctttaaatacaatccagcagtttgactaccagaagaaactggataaccgagagaaggaaagggttgctgcaagacaggcctggtcagtggtcggcaccatcaaagacctgaagcagggctacttatcccaagtaattcacgaaattgtcgatcttatgattcattatcaagccgttgttgtgctggagaacctgaattttggcttcaaaagcaaacgaacaggtatcgccgagaaagccgtgtatcagcagttcgaaaagatgctcatagacaagctgaactgcttagtgctgaaggattatcctgctgagaaggtcggcggcgtacttaacccataccagctgaccgatcagttcactagtttcgccaagatgggaacgcaaagtggcttccttttctacgtgcccgctccctacacgagtaagatcgaccctctgaccggcttcgtcgacccattcgtctggaagaccatcaagaatcacgaatcacggaaacacttcttagaggggtttgacttcctgcactacgacgtgaagacaggggacttcatcttacactttaagatgaatcgaaacctctccttccagcggggcctgcctggtttcatgcccgcatgggacatcgtgtttgagaaaaacgagacacagtttgacgctaagggaaccccctttattgcggggaagcggattgtcccagtcatcgaaaaccatcggttcaccgggcgataccgggatctgtacccggccaacgagctcatcgcgctgctggaggagaagggtattgtgtttagggatggatccaacattctgcctaagttgctggaaaatgatgattcgcacgccattgataccatggttgcactgattagatccgtactgcagatgaggaatagcaatgctgcaaccggggaggattatattaattccccagtgcgagatctgaatggtgtctgttttgactcgcgctttcagaatccagaatggccaatggatgcagacgctaacggggcgtaccacattgctctgaaaggccagctactcctgaaccacctcaaggagagcaaagatctgaagctgcagaacggcatttccaaccaagactggctcgcctacatacaagaactgcgcaattaa

SEQ ID NO: 159 - DNA, 3390 bp, Artificial Sequence
  Description of Artificial Sequence: Synthetic polynucleotide
atggctgtcaaatccatcaaggttaaattacggcttgatgacatgcccgagatccgcgccgggctctggaaactccataaagaagtgaatgctggcgttagatactacacagaatggctctccctgctgcgccaggaaaatttgtaccgccggtcacctaatggagatggagagcaggaatgcgataaaacagcagaagagtgcaaagccgaattgctggagcgactgcgggcacggcaggttgagaatggacaccgaggtccggcgggatcggacgacgagctgctccagctcgccagacaattatatgaactgctggtgcctcaggctattggggcaaagggtgacgcacagcagattgctagaaaatttctgtctcccctcgccgacaaagacgctgtcggcggccttgggatagccaaagccggcaacaaaccccgatgggtgcgcatgagggaggctggtgagcctggctgggaggaagaaaaggaaaaggccgaaaccagaaagtccgccgacaggaccgcggacgtactccgagcattggccgattttgggctgaagcccttaatgcgagtctacaccgatagtgaaatgtctagcgtggagtggaagccattacgcaaagggcaggcagtgcggacgtgggaccgtgacatgttccagcaagccatcgagcgaatgatgagctgggagagctggaaccagagagtggggcaggagtatgccaagctggtcgagcagaaaaaccggtttgagcaaaaaaattttgtaggtcaggaacacctggtgcatctcgttaaccagctccagcaagatatgaaggaagcttcgcctggattagagagcaaagagcagactgcacactatgtaaccggaagagcactgaggggcagtgacaaagtgttcgaaaaatggggaaaactggctcccgatgccccctttgacctgtacgacgcagaaataaaaaacgtgcagcggcgaaacaccaggcgatttggtagccatgatctgttcgccaaattggcagagccggaatatcaggctctttggcgagaagacgcatcatttctcactaggtacgcggtctataactccattttgaggaaattgaaccacgcaaaaatgtttgccaccttcacgttgcctgacgccaccgctcatcccatttggacacggtttgataagctgggcggcaatctgcatcagtatacattcctgtttaacgagtttggagagcgaagacatgcgatacgattccacaagctactgaaggtcgaaaatggcgtggcacgtgaggtggacgatgtcaccgtgcccatcagcatgagcgaacagctggataatttgttgccgcgggacccaaatgaacctatagccctttattttagggactacggggcggagcaacatttcactggggagtttggcggcgcaaaaattcagtgccgacgcgaccagctcgcccacatgcatagaagacgcggggcccgggacgtataccttaacgtctctgtgagggtgcagtcccagtcagaggcaagaggggaacgcagaccaccttacgcagcagtattcaggctggtaggcgataaccaccgggcgtttgtacactttgataaactttctgactacctggccgaacacccggatgacggcaaattaggatcggaggggctgcttagcggcctgcgtgtgatgagcgtcgatctggggctacggacctctgcttccatctctgtgttccgtgtggcccgaaaggacgagttgaaacctaattcgaagggccgtgtaccattctttttccctattaagggaaatgataatctcgtcgcggtgcacgagcgttcccaactgctgaaactgcctggcgagaccgagtccaaagatctcagagcaatccgggaggagcgacaacgtacacttaggcaactccgcacccagctggcctatctgcgcttgctggtgcggtgcggctccgaggatgtagggagaagagagcgaagctgggcaaagctgatagagcaaccagttgacgccgcgaatcacatgacccccgactggcgcgaagcgtttgaaaatgagctgcagaagttgaaatctctgcatgggatttgctcagataaggagtggatggacgccgtatacgagtctgttcgccgggtatggcggcacatggggaagcaggtgagagattggagaaaggacgttcgctctggggaacggccgaaaattcggggatacgcaaaggatgtcgtgggcggcaatagcattgagcagatcgagtacctggaaaggcaatacaaatttctgaaatcttggtctttctttgggaaggtaagcggacaagttatcagagccgaaaagggatctcgctttgctatcacattgagggaacacattgatcacgccaaagaagacaggttgaaaaagttggctgatcgcattatcatggaagcactcggttacgtctacgcccttgatgagcgcggtaaagggaagtgggtagccaagtatcccccatgtcagctgatcctgctcgaggaactttctgagtatcagttcaataacgaccgtcctccctccgaaaataatcagctcatgcaatggtcccaccggggtgtgttccaagaactgatcaatcaggctcaggtgcacgacctcctcgtaggcactatgtatgcagcctttagctcccgttttgacgcgcgcacaggcgcccctggaatacgatgtaggcgagttcccgcacggtgcactcaagaacataacccggagcctttcccatggtggctcaataagtttgttgtggagcataccctcgacgcttgcccattgagggcggatgacttgattcccacaggcgagggggagatcttcgtgagcccattttctgccgaagaaggggatttccaccaaatacatgccgacttgaatgctgcccaaaatctgcagcaaaggctgtggtcagacttcgacatctcgcaaatcagactgcggtgtgactggggcgaagtagacggcgagctggtgctgatacctagactgacgggtaagcgtaccgccgatagctatagtaataaggttttttatacgaatacgggggtgacatattacgagcgtgagagaggcaagaagcgtcggaaggtgttcgcgcaggagaagctgagcgaagaggaggcggagctactggtagaggcagatgaggcaagagaaaagtccgtcgtcctgatgcgggatcctagcgggattattaacagaggtaattggacacggcagaaagaattctggagcatggtgaatcaaagaatcgagggttacctggtgaagcaaattcgaagccgggtgccccttcaagacagcgcatgtgaaaacactggggacatctag

SEQ ID NO: 160 - DNA, 3327 bp, Artificial Sequence
  Description of Artificial Sequence: Synthetic polynucleotide
atggctactcggtccttcatcctgaaaatcgagccaaatgaagaggtgaaaaagggcctgtggaagacccatgaggtacttaaccacggcatagcatactatatgaatatcctaaaacttatacggcaggaggctatctacgagcatcacgagcaagatcctaaaaatccaaagaaggttagtaaggctgaaatccaggctgaattgtgggacttcgtgctgaagatgcagaaatgcaacagtttcacgcatgaagttgataaggacgtcgtgtttaatatactccgggagctgtacgaagaactggtaccaagctctgtggaaaagaaaggagaggccaaccagctaagtaataagttcctctatcctctcgtggaccccaattcacagagcggcaaaggtaccgcatcttctgggaggaaaccacgctggtacaacttgaagatcgctggcgatcccagctgggaggaggaaaagaagaaatgggaagaggataaaaagaaagaccccctggccaaaatcttaggcaagctcgccgagtacggtctgattccacttttcatcccgttcacagatagcaatgagccgatcgtcaaggagattaagtggatggaaaagagccgcaatcagagtgtgcggaggctggacaaagacatgtttattcaggccctggaacgcttccttagctgggaaagctggaacctgaaggttaaggaagagtacgaaaaagtcgagaaggagcataagactttggaggagcgcatcaaagaagacatccaggcctttaagtctctagaacagtatgagaaagaacggcaggaacagctgctgcgtgatacactgaacacaaacgaatatcgcctgagcaagaggggactcagaggctggagagaaatcattcaaaagtggctcaaaatggatgaaaatgagccgtctgaaaaataccttgaagttttcaaggactaccagcggaagcaccctagagaagccggcgactatagtgtttacgaattcttgagcaagaaggagaatcattttatatggaggaatcacccggagtacccatatctgtacgcaaccttctgcgaaatcgacaagaaaaaaaaagacgccaagcaacaggctacatttactctggccgaccctatcaatcaccctctatgggtccggtttgaggagcgctccggaagcaatctgaataaatatcgtattctgactgaacagttacacacagagaagctcaagaagaaacttacggtgcagctggaccgcctgatatacccaacagagtccggaggatgggaagagaaaggaaaggttgacatcgtactgcttccatctcgtcagttttacaaccagatattcctggacatcgaggagaaggggaaacacgccttcacatacaaggacgagtccataaagttcccactgaagggtactttaggcggtgctagggtgcagttcgaccgcgatcacctgagacggtacccccacaaggtggagagcgggaacgtgggacgaatctactttaatatgacagtgaacattgaacccacagagagtccagttagtaaatccctgaaaattcaccgtgacgactttccgaaatttgtgaatttcaagccaaaggagcttacggagtggatcaaggattcaaagggaaagaagctgaaatctggtatcgaatctctcgagatcggtctccgtgtcatgagcatcgatctgggacagcgccaggcagctgccgccagtatattcgaggtggtagaccaaaagcctgacatcgagggaaagctcttcttcccaatcaaaggcacagagctgtatgcggtgcaccgggcgtcctttaatataaagctgcccggtgaaaccctggtgaagtcacgggaggtgcttagaaaagcgcgagaggataacctcaaactgatgaaccaaaaactgaactttctgaggaacgtcctgcactttcagcagttcgaagatattaccgaacgcgaaaagagagtaaccaagtggatatctcgtcaagagaacagcgacgtcccgttagtctatcaggacgaactcatccaaatacgggagttgatgtataagccctacaaggattgggtcgcctttcttaagcagcttcacaaacgcctagaggtcgaaataggtaaagaggtgaaacattggcggaagtcgctcagcgacgggaggaagggactttatggcatctctttgaagaacattgacgaaatcgatagaaccagaaaatttttgttgagatggtccctccgacccaccgagcctggagaggtgaggcggttagaaccaggacagaggttcgctatcgatcagctgaatcacctcaatgctctgaaggaggaccgcctcaagaaaatggccaatacaatcataatgcacgcccttggctactgctacgacgtccgaaagaagaagtggcaggccaagaatcccgcctgtcaaattatcctttttgaggatcttagcaattacaacccctatgaagagcggtccagattcgaaaatagtaagctcatgaagtggagccgcagggagatcccgcgccaagtggcccttcagggggaaatttatgggctgcaggtaggcgaggtcggggcccaattctcctcgcgctttcatgcgaaaactggaagtcctggaatccggtgctcagtggtgacaaaggagaagttgcaagacaatcggttttttaaaaacttacagcgggagggaaggctgaccctggataagatagccgtacttaaggaaggagatctgtaccctgacaaaggcggtgaaaagttcattagcttgagcaaggaccgaaaacttgtgaccacccacgctgacatcaatgcggcacagaacctgcagaagagattttggactcgcacccacggattctacaaagtttactgcaaagcatatcaagtagacggacagaccgtatacatccccgagtccaaagatcagaagcagaaaattattgaagagtttggggaagggtactttatcctgaaggatggtgtctacgaatggggcaacgctggtaaacttaaaattaagaagggcagctctaaacagtcctccagcgagttagttgattctgatattctgaaagacagtttcgacctggccagcgaacttaaaggggaaaaattaatgctgtaccgggaccccagcggaaacgtctttccatccgataagtggatggccgctggagtgttctttggcaagttagagaggattctcataagtaagctgaccaaccaatactcaatctccacaatcgaggatgactcatccaagcagtctatgtga

SEQ ID NO: 161 - DNA, 3450 bp, Artificial Sequence
  Description of Artificial Sequence: Synthetic polynucleotide
atgcctacacgcactatcaacctgaaactggttcttggcaagaatccagagaatgctacccttcgtcgggcactattttcaacgcatagactggtgaatcaggctaccaaacggattgaagagttcctcttgctttgtcggggggaagcatataggacggtggataatgaggggaaagaggctgaaattccgagacacgccgtgcaggaggaagctcttgcgtttgcaaaggccgctcaacggcacaatggttgcatctctacttatgaagaccaggaaatcctggatgtgctccggcaactgtatgaaaggctggtgccttctgtgaatgaaaataatgaagcaggggacgctcaagccgcaaacgcgtgggtgtcgccactgatgtccgccgagtccgagggagggctcagcgtttacgacaaggtgctggacccacccccagtgtggatgaaactcaaagaggaaaaagctccgggctgggaggctgcttcccagatctggatccagtccgacgaagggcagtcccttcttaacaagcctggttcgcccccgcggtggattaggaaactgaggtcaggccagccttggcaggacgattttgttagcgaccagaaaaagaagcaggacgagctgacaaaggggaatgcgccactgatcaaacaattaaaggaaatgggcttattgcctcttgtgaatcccttttttagacatctgcttgacccggaggggaagggggtgtcaccttgggacagactcgctgttagggccgctgtcgctcatttcatatcatgggaatcatggaaccaccggacacgcgccgaatacaatagtttgaagctgcggagggatgagttcgaagcagcttccgacgaattcaaggacgacttcacgctgcttcggcagtacgaggctaagaggcactccacactgaagagtatagctttagccgatgattcaaacccttataggatcggcgtacgctccctccgcgcttggaaccgcgtccgcgaggagtggatcgacaagggagcgaccgaggagcagcgggtcaccattctcagcaagttgcagacccaactaaggggcaaatttggagatcctgacttgttcaactggctggcgcaggaccggcacgtgcacctctggagccctagagatagtgttaccccactggttaggatcaacgctgttgacaaagtattgcgacggagaaaaccgtacgccttgatgacttttgcccacccaagattccaccctcggtggatactttacgaagccccagggggcagcaatctccgccagtatgcactggattgtaccgaaaatgctctgcacattacactgcctctgctggttgacgatgcacatggcacatggattgagaaaaaaattagggttcctcttgcccccagcggccagattcaggacctgacactagaaaagctcgagaagaagaaaaatcgtctctactaccgttctgggttccagcagtttgccggcctggccggaggtgccgaggtgcttttccatcgaccatacatggagcacgatgagaggagcgaggagagcttattagaacgccctggtgctgtttggttcaaactcaccttggacgtggcaacccaggcccctccaaactggttggacggaaagggccgcgtccgaacgccccccgaggttcaccacttcaagacagccctcagtaacaagtctaagcacacacggaccctccagcccggactcagagtgttatccgtggatctgggaatgcgcaccttcgcctcttgctccgtatttgagctgatcgagggcaaaccagagactggcagagcgttccctgtggccgacgaacgttccatggattcaccaaacaagctgtgggccaagcacgaaagatcctttaaactcacgctccccggcgaaacccccagtcggaaagaagaggaggaacggagcattgcaagagccgaaatctatgcgttgaaaagagatattcagagattaaaaagtcttctgcgcctgggggaagaggataacgataatagacgcgatgcacttcttgagcaatttttcaagggctggggcgaggaagacgtggttccaggtcaggcctttccccggagtctgttccaggggctgggggccgccccattcagatccacccctgagttgtggagacaacactgtcaaacctattatgataaagcagaggcgtgcctggctaaacacatcagcgattggcgcaagagaaccaggcctaggcctacctcacgtgagatgtggtacaagacacgctcttatcacggcggaaagtcaatctggatgctggaatacctcgacgctgtgaggaaactgctcttatcctggagcctcagaggccggacctacggggctatcaacagacaggacacagcaaggttcgggagcttagccagccggctccttcaccacattaactcactcaaagaggatcgaataaagaccggagccgactcgatcgtgcaggcagcccgagggtacatccccctgcctcatgggaagggctgggagcagcgatatgaaccctgccagctgatcttgtttgaggaccttgcccgttatagatttcgcgttgatagacctcgccgtgagaattctcagctgatgcagtggaaccacagagcgatcgtggctgagaccactatgcaggccgagctgtatggacagatcgtggagaacaccgccgcagggttcagttctcggtttcatgctgccaccggagctcccggcgtccggtgccgcttcctcttagagcgtgattttgacaatgacctcccaaagccctatctgctgagggaactgagctggatgctggggaacacaaaagtagaatcggaggaggagaagctacggctcctctccgaaaagatacgtccaggctctctggtaccatgggacggaggagagcagttcgcgacactgcatcctaagagacagacgttatgtgtgattcacgccgatatgaacgccgctcagaatctgcagcgaagattctttggccgctgcggcgaagccttcaggctggtatgtcagccccacggggatgatgtgctgcggctggcctcaacccctggggctagactcttgggggcactccagcagctggaaaatggccaaggggctttcgaactcgttcgggacatgggcagcacaagccagatgaacagattcgtcatgaagagcctgggaaagaaaaagatcaaacccttacaggacaataatggcgacgacgaactggaggacgtgttgtccgtgctgccagaggaagacgacacaggccgcatcactgtcttccgcgactcaagtgggatattctttccttgcaacgtgtggattccggccaaacagttctggcctgccgtcagagccatgatttggaaagtgatggctagtcattcattgggatga

SEQ ID NO: 162 - DNA, 3759 bp, Artificial Sequence
  Description of Artificial Sequence: Synthetic polynucleotide
atgacaaagctgaggcacagacaaaagaagcttacacacgactgggcagggagcaagaaacgtgaggtccttgggtcaaatggaaaactgcagaaccccttgctcatgcctgtaaagaaggggcaggtaacagaatttagaaaagcattctccgcgtacgctcgggcaactaagggggaaatgaccgatggacggaagaacatgttcacccattctttcgagccattcaaaacaaagccgtcattgcaccaatgcgagctggccgataaggcttaccagtctttgcatagttacctccccggttccctggcccatttcttgctttccgcacacgcactgggctttcgtattttctctaaatctggggaggcaactgccttccaggccagctcaaaaatcgaggcctatgagtccaagctcgcttcggagctagcctgtgtcgatttgagtatccagaatttgacgattagtactcttttcaacgctctcacaacttcagttcggggcaagggggaggaaacttcagcagatccccttatcgcacggttctacactctcctgacgggcaagcccctgagccgagacacacagggcccagaacgggacttggcagaggtcatctccagaaagatcgcctcgtccttcggcacatggaaggaaatgactgccaaccctctgcagagcctccagttcttcgaagaagagcttcatgcactagatgccaacgtgtctttatctccagcttttgatgtgttaatcaagatgaatgatctccaaggtgatctgaagaaccgtactatagtgttcgacccagatgcacccgtgttcgagtacaacgctgaggatccagccgatatcatcataaagctgacagctcggtatgcgaaggaggccgtcatcaagaatcagaacgtgggcaattatgtgaaaaacgccattaccaccactaatgccaatgggctggggtggctcctcaataaagggctttcactactgccagtttctactgacgatgagctgctcgaattcattggggtggagagaagccatcccagctgtcacgcgctgatagagctgattgcccagctagaggcgccggaactgtttgagaagaatgtgtttagtgacacccgttccgaggttcagggtatgatcgacagtgcagtgtcgaaccacattgctcggctgtccagcagccgaaactccctgagcatggacagcgaggaattggaacgcttgattaaatctttccagattcatactccccattgttctctgttcataggcgctcagtccttatctcagcagctggagagcttacctgaggcgctgcagtccggagtgaacagcgctgatatcttattaggcagcacacagtatatgctgaccaactctctcgttgaagagtcaattgcaacatatcaaaggacattaaataggatcaattacctgagtggggtggctgggcagattaacggtgctatcaaaagaaaggcaatcgacggcgaaaaaatacacctgcctgccgcctggagtgagctcatctccttacctttcattggacagccggtgattgatgtggagagcgacctggcacacttaaaaaaccagtaccagaccctgtccaatgaatttgacaccctcatttcggccctgcagaagaacttcgatttgaatttcaacaaagcactccttaaccgcacgcagcatttcgaggcaatgtgccggagcacaaaaaaaaatgctttatctaagcccgagatcgtgtcctacagagatctgctggcgcggctgaccagttgcctttatcgaggctcgctggttctcagaagggcgggaatcgaagttctgaaaaagcacaaaatctttgagtcgaatagtgagctgagagaacacgtccacgagcgaaagcacttcgtgttcgttagtccattggacagaaaggcaaaaaaactgttgcgcctgaccgattcccgccctgacttgctccatgtgatcgatgagatcctgcaacatgacaatctggagaataaggacagagagtccctttggctggtccggtctgggtacctccttgctggtctgccggaccagctgagttcttcgtttatcaatctccccataatcacgcaaaagggcgatcgccggctgattgacctgattcagtatgaccagatcaatcgcgatgctttcgtaatgttggtgacaagtgctttcaaaagcaatctctctgggttgcagtaccgcgctaacaagcagtctttcgtggtcacccgcaccctgtctccttacctgggtagtaagctcgtatacgtccctaaagacaaagattggctggtcccatcccagatgtttgagggaagattcgccgatattctgcagagtgactacatggtctggaaggatgccggacgcctgtgcgtgatcgacactgccaaacatctctctaacattaaaaaaagcgtgtttagtagcgaagaagtccttgcttttcttcgagagctgcctcaccggaccttcatccagaccgaggtacgggggttaggagtgaacgtcgatggaatcgcatttaataacggggatatcccgagcttgaagacattctcgaattgtgtgcaggtgaaggtgagtaggactaatactagtctcgtgcagactctaaacaggtggttcgagggtggcaaagtgtcacctccctctattcagttcgaaagagcttactacaaaaaagacgatcagattcacgaggacgcagccaagagaaagatacgcttccagatgccagcaacggaattagtgcacgccagcgatgacgctggttggacccccagctacctgctgggcatcgaccccggtgagtacggaatgggtctcagtttggtgtccatcaacaatggagaggtcctggattctggattcatccacattaattccctgatcaatttcgcgtccaaaaaaagcaatcaccagaccaaagtagtcccccgccagcagtacaagtccccctacgcgaattatctcgagcagtcaaaggattcagcagcaggggatatagctcacattctggatcggctaatctacaaattgaacgccttgcctgtgttcgaggcgctgtctggcaacagtcagagtgctgctgatcaggtatggaccaaagttctatccttctatacatggggagacaacgacgcacagaacagtatacggaagcagcactggttcggtgcctcacactgggatattaaggggatgctgcgccaacccccaaccgaaaaaaaacccaaaccatatatagcctttcccgggagtcaagtgtcatcctatggaaatagtcaaaggtgtagttgttgcggccgcaatcccattgagcagttgcgtgagatggcaaaggacacgagtatcaaggagctgaaaatccgaaatagtgagatccaactattcgatggtacaatcaagctgtttaaccccgacccttccaccgtcatcgagaggcggcggcataacctaggaccctcacgcattcctgtggcagaccgaactttcaagaatattagcccttcttcgttagagttcaaggagctcattactatcgtttctcgaagcatccgccatagccccgaatttattgctaagaaacggggtatcgggtctgagtacttttgtgcttattctgactgcaactcctcactgaactcagaggccaatgccgcggccaatgtggcacagaagtttcagaagcaactctttttcgaactctga

SEQ ID NO: 163 - DNA, 3864 bp, Artificial Sequence
  Description of Artificial Sequence: Synthetic polynucleotide
atgaaacgtattctgaactctctgaaagtcgccgcactgaggctgctgtttcgaggaaagggctcagagctggtgaagaccgtcaagtaccctctggtttcgcccgtccagggtgctgtggaagaactcgccgaagcaatacgccacgacaacctacatttatttgggcagaaggaaatcgtagatctgatggagaaggacgagggcacccaggtctactcggtggtggacttttggctcgacacactccgtctagggatgttcttcagtccaagtgctaatgcccttaagatcactctggggaagtttaacagcgaccaagtttcccctttcaggaaggttctggagcagtcccctttctttctcgcgggtagactcaaagtggagcccgctgaacgtatcctcagcgtggagatccgcaagatcggtaagagggagaatagagtggagaactacgccgcagatgtagagacttgttttatcggtcagctgtctagtgatgaaaagcagtctatccagaagctcgctaacgatatctgggactctaaggatcacgaagagcaaaggatgcttaaggcggatttctttgccattcccctcatcaaagacccaaaggcagtgaccgaggaagatcccgagaatgaaaccgcaggcaaacagaagcctctcgaattatgtgtgtgcttagtgcccgagttgtacacccgcgggttcggttcaatagcggacttcctggtccagcgtctgacactattaagagacaaaatgagcacagacacagcagaagactgccttgagtatgtcggcatagaggaggagaagggtaatgggatgaactcgctgctggggacgttcctcaagaacctgcagggagacgggttcgaacagatcttccaatttatgctcggcagttacgtgggatggcaaggtaaggaagacgtcctacgcgaacggcttgatttgctagcggagaaggttaaaagactgccgaaacctaagtttgccggcgagtggtccggccatcggatgttcctgcatggtcaattgaagagctggtcctctaactttttccgcctgtttaacgagactagggagctcctcgaaagcataaaatccgacatccaacacgcgaccatgttaatcagctacgtcgaagagaaagggggataccacccacaactcttgtcacagtacaggaaactaatggagcagctgccagctctcagaacaaaggtgttagatccagagatagaaatgactcacatgagcgaggcggtaaggtcgtacattatgatccacaagtcggtagcaggatttctgcctgacttactcgagtccctcgatagggacaaggacagggaattcctgctgagtatatttccaaggatccccaaaattgacaaaaaaactaaggaaatcgtggcctgggagctcccaggcgagcccgaagaaggatacctgttcactgccaataatctttttcgcaactttctggagaatcctaaacatgttccacgtttcatggcagaaaggatcccggaagattggacgcgcctgcggtccgctcccgtatggtttgacggcatggtgaaacaatggcagaaagtggtaaaccagctggtggagtcacctggagcattgtatcagttcaatgaaagctttctccgacaacgtttacaggcaatgctgacagtgtataagagagacctgcagacagagaaattccttaagttgttggctgatgtctgcaggcctctggtggacttctttgggctggggggaaacgatatcatcttcaaaagctgccaggacccgaggaaacaatggcaaactgtcattcccttgagtgtccccgctgatgtgtacaccgcgtgtgaggggctggcaatccggcttcgtgagacattgggatttgagtggaagaaccttaagggccatgaaagggaggactttctaagactgcaccagcttttagggaatctgcttttctggattcgagatgccaaactggtggtgaaattggaagattggatgaataatccctgtgttcaggagtacgttgaggctcgtaaggccattgatctcccactggagatcttcggctttgaggtccccatcttcctgaacggatatctgtttagtgaactgaggcagttagaactgctgctccgccgtaagtcggttatgaccagctattcggttaagacaactggcagtccaaacaggcttttccagttagtctacctgccattaaatccttccgaccctgagaaaaaaaattctaataactttcaggaacgcctggacacccccactggcttatcacgtcgcttcctggaccttactctggacgccttcgccggcaagttgctgacagaccccgtgactcaagagcttaaaactatggctgggttctacgatcacctgtttggtttcaagctcccatgtaagctggcagccatgtctaaccaccctggctctagcagcaagatggtcgtgttggccaaacctaaaaaaggggttgcatctaatataggattcgaaccaatccctgatcccgcgcaccccgtattccgggtgagatcatcatggccagagctgaagtatctggaggggttactgtatcttccagaagacactccactgacaatagagctcgcagagacaagtgttagttgtcagagcgtcagtagcgtggcattcgatctgaaaaatctgactactatccttggacgcgtgggtgagttccgtgtgaccgcagaccagccttttaagttgacccccatcatccctgagaaggaggagtccttcataggaaaaacatatctaggccttgatgccggggaacgctcaggcgtagggttcgctatcgtcacagtcgacggggatgggtacgaggtacagcgcctgggggtgcatgaagatacacagctgatggccctacagcaggtggcctctaaaagcttgaaggagccggtgttccagccgctcagaaagggtacttttcggcagcaggaacgtattagaaaatctctcagaggatgttattggaacttctatcacgctctgatgattaagtaccgcgccaaggtagtgcacgaagagagcgtgggcagttccggcctggttgggcagtggttacgagcattccagaaggacctcaagaaagccgatgtgttgccaaaaaagggaggcaaaaacggagtcgataagaaaaagagagagtcttctgcacaagacacattgtggggaggggcttttagcaagaaggaagaacagcagatagctttcgaagtccaagctgctggttctagccagttctgcctgaagtgcggatggtggttccaactcggaatgcgtgaggttaatcgcgtgcaggaatccggcgtcgtgctggattggaatcggagtattgtcacattcctgattgagagctctggcgagaaagtgtatgggttctcccctcagcaactcgaaaaggggttcagaccagacattgaaaccttcaagaagatggttcgggatttcatgcgcccgcctatgtttgaccggaagggtcgcccagcagctgcctacgaaaggtttgtcttgggacgccggcatcggcggtatagattcgacaaggtttttgaagaacgattcggacgatccgcgctattcatttgcccgagggttggctgtggcaactttgaccacagcagcgagcagtcagccgtagtgctggctctaatcggatatattgccgacaaagaggggatgagcggaaaaaagctagtctacgtgcgtctggcagaactaatggcggaatggaaattgaagaaactggagaggagtagagttgaggagcaaagctccgctcagtga

SEQ ID NO: 164 - DNA, 3579 bp, Artificial Sequence
  Description of Artificial Sequence: Synthetic polynucleotide
atggcggagtcgaagcaaatgcagtgcaggaagtgtggagcctctatgaagtacgaagtgatcggcctcgggaagaaaagctgcagatatatgtgtcccgactgcgggaatcacacatctgcaagaaagattcagaataagaagaaaagggacaagaagtatggatctgccagtaaagcacaaagccaacgaatcgcagttgcaggggccttatacccggataaaaaggttcagaccatcaagacttataagtatccagccgacctgaatggtgaggtccatgactcaggggtggccgaaaaaatagcccaagcaatccaggaggatgaaatagggctcctcggcccctcttccgagtacgcctgttggatcgctagccagaaacagagcgagccctacagtgttgtagacttttggtttgacgctgtgtgcgccggaggcgtgttcgcctattctggggctagattgctgtctaccgtcctgcagctatctggggaggagagcgtcctacgcgcagccctggcatcctccccttttgtcgacgatatcaatctggcacaggccgaaaaatttctggcggtgtccaggcgaaccggccaagataagctggggaagcgcattggagagtgcttcgcagagggccgacttgaggccctaggcatcaaggaccggatgcgtgaatttgtccaggctatcgatgtcgctcagaccgctgggcagcgttttgccgcgaaactgaaaatctttgggatttctcagatgcccgaggcaaagcagtggaacaatgacagcggactcaccgtgtgcatcctgcccgactattacgtcccagaagaaaatcgcgcagatcagttggtcgtcctgctaagacgactgagagagatagcatactgtatggggatcgaagatgaggccggttttgaacatcttggaattgatcctggcgcactatcaaatttttccaatggcaatcctaaacgcggatttttgggccgcctgctgaacaatgatattattgccttagcgaacaacatgtccgccatgacgccttactgggagggcaggaagggagaactgattgaaagattggcttggctgaagcaccgtgcagaggggctttatctgaaggaaccgcattttggaaatagttgggccgaccataggtctagaattttttccagaatagccgggtggctttctgggtgcgctgggaagctaaagatcgccaaagaccagatcagcggagtgcgtactgatctgttccttctgaagagactgctggatgcggtcccgcagtccgccccttctcccgacttcatagcctctatctctgccttggatcgcttcctggaggccgcagaatctagtcaggatcctgccgaacaggtgagggccctatacgcctttcatctgaacgcacccgcggtgcgaagcatcgccaacaaggcagtccagcgatccgacagccaagaatggcttataaaggaactggacgctgtggaccacctggagtttaacaaggcctttcccttcttctctgatacgggaaagaagaaaaagaaaggggctaactcgaatggcgctccgtccgaggaggagtacaccgagactgagagcatccagcagcccgaggacgctgagcaagaggttaatggtcaggaaggcaacggggcctcgaagaaccagaagaagtttcagagaatcccccgattcttcggcgaggggagtcgcagcgagtatcgcatcctcactgaagccccgcagtacttcgacatgttctgtaacaacatgcgggccatctttatgcaattagaatcccaaccgcgtaaagctcccagggattttaagtgtttcctgcagaatcggctgcagaaattgtataagcagacattcctgaacgctcgatccaacaagtgccgggcattactagagtccgtattgattagttggggagagttttacacctacggggctaacgagaaaaaatttcgactgcgtcatgaagcttctgagcgctcctcggacccagattacgtggtgcaacaggcgctggagatcgctcggaggctgtttctcttcggctttgagtggagggactgtagcgcaggtgaaagagtggatctggtcgaaatacataagaaagccatatctttcctgttggccatcactcaggctgaggtgtctgtgggcagctataactggctgggcaattctaccgtgagtcggtacctgtccgtggcagggactgataccctttacggcacccagctggaagaattcttaaatgcaaccgtgttatctcagatgcgggggctggctatcaggttatcatctcaggaactgaaggatggatttgacgtacagctggagtctagttgccaggataatctgcaacacttgctcgtgtacagggcttcacgagaccttgccgcctgcaagcgcgctacttgtccagctgagttggatcctaagattctggtactgcccgtgggggcctttatcgctagcgtgatgaaaatgattgaaagaggggatgagcctttagctggagcttatctgagacacagaccccatagtttcgggtggcagatccgcgttcgaggtgtggcagaggtgggaatggaccaagggaccgccctggcgttccagaaaccgaccgagagcgaacccttcaagataaagccgttttccgctcaatacggccccgttctatggctgaacagctccagttatagccagagccagtacctggacgggttcctatcacagcccaagaactggagtatgcgggtgctgccacaggccggctcagtgcgggtagaacagcgcgtcgccttgatttggaatctccaggccggaaagatgaggctggaacggagcggagcgcgggctttcttcatgcccgtcccattcagtttccgccccagtggcagcggcgacgaggcagtcctggctccaaataggtacctgggactctttccacacagcggcggcatagagtacgctgtggtcgatgttcttgactctgccggcttcaaaatactcgagagaggaacaatagccgtcaatggcttctcccagaaacgaggagaaagacaagaggaagcccatcgcgaaaaacaaagacgcggtatctccgatattgggcgcaagaagccagtccaggccgaagtcgatgcggccaacgagctccatcgaaaatacaccgatgttgctactcggctggggtgtcgaattgtcgttcaatgggcaccccaacccaaaccaggcactgcgccgaccgctcagactgtgtacgctagggccgtgaggactgaagcaccaagatccggcaatcaggaagatcacgccaggatgaaatcttcctggggatacacatggggtacgtattgggaaaaaaggaagcccgaggacatcctcggcattagtacccaggtgtattggacaggcgggatcggcgagtcctgcccggctgtcgccgtcgcgctattgggacacatcagggccacctcaacccagactgaatgggagaaagaggaagtcgtgtttgggcgattgaaaaagttcttcccatcctga

SEQ ID NO: 165 - DNA, 2958 bp, Artificial Sequence
  Description of Artificial Sequence: Synthetic polynucleotide
atggagaagcgcatcaataaaattcgcaagaagctgtctgccgataacgccacaaaaccagttagtcgaagcggcccaatgaagaccctgctagttcgagtgatgactgatgatctgaagaaaaggctcgaaaagcgacgcaagaagcctgaggtaatgcctcaggttataagtaacaatgcagcaaacaatctgcggatgctgcttgacgattacacaaagatgaaggaagccattctccaggtgtattggcaggagttcaaggatgatcacgtaggcctgatgtgtaaattcgcgcaacctgcaagcaagaagatcgaccaaaacaagctgaaacccgagatggatgaaaaaggcaatttaacaaccgccggattcgcttgttcccagtgtgggcagccactgttcgtgtacaagttagaacaggtgtcggaaaaaggaaaggcatacactaactactttggacggtgcaatgttgcagaacacgaaaagctgatactgcttgcccagcttaagcccgaaaaagacagcgacgaagcggtgacctacagcctgggaaaattcgggcagcgggcactggacttctattctatccacgttaccaaggagagcacccacccagtgaagccgttggcccaaatcgctggaaaccggtacgccagcggaccagtcggcaaggccctgtccgatgcctgtatgggcacaattgcttctttcctgtccaagtaccaggacatcataatcgagcaccaaaaagttgtgaaagggaatcagaaacgcctggaatcccttcgagaactggccggcaaggagaaccttgagtacccgtccgtgaccctgcctccacagccacataccaaagagggcgtagacgcgtataatgaggtcattgcccgcgttcgcatgtgggttaatttaaacctgtggcagaaattaaaactaagccgagatgatgctaaaccgttactgagattgaagggattccctagctttcctgtggtggagagaagggaaaacgaggttgattggtggaatactattaatgaggtgaaaaagcttattgacgccaagagggatatgggcagggtgttctggagcggggtgactgccgaaaagagaaataccatcctcgagggatacaattacctccccaacgagaatgatcataagaaaagagaggggagcttagagaatccaaagaaacctgcaaagaggcaattcggtgatctcctgctctacctcgagaagaaatacgcgggggactggggaaaagtttttgacgaagcctgggagcgcattgacaagaagatcgccgggctgacgtctcacattgaacgggaagaggcacggaatgcagaggacgcccagtctaaggccgtgctgactgactggctgcgcgcaaaggcctccttcgtgctcgaacgtctgaaggaaatggatgagaaagagttttacgcgtgtgaaatacagctgcagaagtggtacggcgatctaaggggaaatcccttcgcagtggaagccgagaatagggtagttgacatcagtgggttctccatcggcagtgatggacattctatccagtatagaaacctgctcgcctggaagtacttagagaacggcaagagagagttctatctgctgatgaactacgggaaaaaaggtagaattcgctttacagatggcaccgacataaagaagtccggaaagtggcaaggcctcttatacggaggcggcaaagcaaaggtgatagacttgacttttgaccctgacgacgaacagctgataatcttgccgctggcctttggcacaagacaaggtagggaatttatctggaatgatcttctttctctcgagaccggactcatcaagctcgcaaacggaagggtcatcgagaagacaatctacaataaaaagataggccgagacgagccagccctgtttgtggctttgacatttgagcggagagaggtcgtagatcccagcaacatcaaacccgtgaacctgatcggtgttgacaggggcgagaacatcccggcggttatcgcactgacggatccagaaggatgtcctctgcccgagttcaaagattcatcgggagggccaaccgacattttgaggataggggaggggtacaaggagaagcagcgagctatccaggcggccaaagaagtggagcaacgaagagctggtggttattctcgcaagttcgcttccaaaagtcgtaacctggctgacgatatggtgcgcaattctgcccgtgaccttttctaccacgccgttacacacgacgccgtgttagtgtttgaaaatcttagtcgaggcttcgggcgacaggggaagcggacctttatgaccgagagacagtatacaaaaatggaggattggctgaccgccaaactggcgtatgaaggactcacatccaagacctatctctcaaaaactttggcccagtatacatctaagacgtgcagtaactgtggcttcaccattaccacagctgactacgatggcatgctggtccgcttaaaaaagacatctgacggctgggctactaccctcaacaataaagagctcaaagccgaaggacaaattacctattataacaggtataaaagacagactgtcgagaaggagttgagcgcggagctggaccgcctatcagaggagtcagggaacaacgatatctctaagtggactaagggacgccgagacgaggcgttgttcttgctgaaaaagcggttctctcatcgacccgtgcaggagcagttcgtgtgtctggactgcggccacgaggttcatgctgatgagcaagctgctctaaatattgcccgtagttggttgttcctgaacagcaattcaacagagttcaagtcatacaagagcggaaagcagccgtttgtgggcgcatggcaggcattttacaaaagacgcctgaaggaagtgtggaagccaaacgcc

SEQ ID NO: 166 - DNA, 2919 bp, Artificial Sequence
  Description of Artificial Sequence: Synthetic polynucleotide
atgaaaaggattaacaaaatccgaaggcggcttgtaaaggattctaacaccaaaaaggctggcaagacggggcccatgaaaacattactcgttagagttatgacccccgacctcagagagcgactggaaaatttacgcaagaagccagagaacatacctcagccaattagtaatacctctcgggcaaacctaaacaagttgcttactgattacacggagatgaaaaaggccatactgcatgtgtactgggaggagtttcaaaaggaccctgtcgggctaatgagcagggtggctcagcctgcacctaaaaacatcgaccagcggaaactcatcccagttaaggacggaaatgagagattgacaagttcaggtttcgcctgctcacagtgctgtcaaccgctgtacgtttataagttagaacaagtgaatgacaaaggaaagcctcacacaaattattttggccggtgtaatgtctctgagcatgagcgtctgattctgttgtccccgcataaaccggaagctaatgacgagctcgtaacctacagcttggggaagtttggccaaagagcattggacttctattcaatccatgtgacccgcgaatccaatcatcccgtcaagcccttggagcagatagggggcaatagttgcgcttctggccctgtgggcaaagccctgtccgacgcctgtatgggagccgtggcttcattcctgaccaaatatcaggatatcatcttggagcaccagaaagtgatcaagaaaaatgaaaaaaggttagcaaacctcaaggatattgcaagcgctaacggcttggcttttcctaaaatcacacttccacctcagcctcacacaaaggaaggcatcgaggcatacaacaatgtggtggcccagatcgtcatctgggttaacttaaacctgtggcagaaacttaaaattggcagggatgaggcaaaacccttacagcgcctgaaaggattccccagctttccactggtggagcgccaggctaacgaagtggactggtgggatatggtgtgtaacgtcaagaagctcatcaatgaaaagaaagaggacggtaaagtcttctggcagaacctcgccggttacaaacggcaggaggcgctgttaccttatctgtcgagtgaagaggaccggaaaaaaggcaagaaatttgctcgttatcagtttggtgatttgctcctacatttggagaagaagcacggcgaggactggggaaaagtatacgatgaggcctgggagaggattgacaaaaaggtggagggactgtcaaagcacatcaagctcgaagaagagcgcagaagcgaggacgcccaatccaaagcagcgctgactgactggctgcgggcgaaggccagttttgtaatcgaaggccttaaagaagccgacaaggatgaattctgcagatgcgaattaaaactccagaagtggtacggcgatctccgaggtaagcctttcgcaatcgaggccgagaattccatactggacattagtggattcagtaaacagtataattgtgcctttatatggcagaaggatggtgtcaagaaactcaacctgtaccttattattaattatttcaaaggcgggaaactgagatttaagaagataaagcctgaagcctttgaggcgaaccgattctacacagttattaacaagaaatctggtgaaattgtacccatggaggtaaacttcaacttcgatgatcccaatctgattatattgccactagcttttggcaagcggcagggtagggaattcatttggaacgatttgctttcactggaaacagggtcccttaagctggcaaacgggagagtgattgaaaagacattgtacaatcggaggacacgtcaggatgaacctgcccttttcgtggctctgacattcgagcgcagggaggttctggactctagcaatatcaagccaatgaacctgatcggcatagaccgaggagagaatattccggctgtgatcgcactcaccgatcccgaaggatgtcccctttctcggttcaaggactccttaggcaatccaactcatatcctgagaatcggcgagtcatacaaggagaagcagcgaacaattcaggccgccaaggaagtcgagcagaggcgagctggcggctacagccgtaaatacgctagtaaagctaagaacctggccgacgatatggtgcgcaatactgctagagacctgctgtactatgcagtgacgcaggacgcaatgctgatattcgagaatctgtccagaggattcggaaggcagggcaagcggacgttcatggccgagcgccagtatacaaggatggaggattggttaacggccaagcttgcctatgaggggctacctagtaagacctatctgtctaagacgctggctcaatacaccagtaagacctgctcaaactgtggctttacaatcacttctgctgattatgatagagtgctcgagaagctaaaaaaaactgccaccggctggatgactactattaatgggaaggaactgaaagtggaaggacagattacctattataatcgctacaagcgtcaaaacgtcgtcaaggacctgtcggtggaattggacagactcagtgaagagtccgtgaacaatgatatcagctcctggacaaaagggcgcagtggggaggcactcagcttgcttaaaaagaggttttcacatcggccggtccaggagaaatttgtctgcctgaactgcggattcgagacacacgccgacgagcaggcagcactgaacattgccagatcctggctgttccttaggtcccaggaatataagaagtaccagactaacaaaaccacgggaaacacagataaaagggcctttgtcgaaacttggcaatccttttaccggaagaagttaaaggaagtgtggaagccc

SEQ ID NO: 167 - DNA, 4107 bp, Artificial Sequence
  Description of Artificial Sequence: Synthetic polynucleotide
atggataagaaatactcaataggcttagcaatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 168 - DNA, 4107 bp, Artificial Sequence
  Description of Artificial Sequence: Synthetic polynucleotide
atggataagaagtattcaattggacttgcgattggcactaacagtgtgggctgggcggtgattacagacgagtataaggtgccgtcaaaaaagtttaaagttctgggcaacactgatcgccattccatcaagaaaaacctaatcggggcccttctttttgatagtggcgaaacggccgaggcgacgcgtctaaaacgtaccgcgcggcgtcgctacacccgacgaaaaaaccgtatttgttaccttcaggagatcttcagtaacgaaatggctaaggtggacgattcattcttccaccgtctggaggagtcctttttagttgaagaagacaagaagcatgagcgacacccaatttttggtaacattgtcgacgaagtcgcctatcacgaaaaatatccgaccatttatcacctgcgcaaaaaactggtcgatagcacggataaagcggatctgcggcttatttacctggcgcttgcccacatgatcaagttccgcggccacttcctgatagaaggagacctgaacccggataatagcgatgtagacaaactgtttattcagctggtccagacctacaaccagctgtttgaagaaaatccgattaatgcgtcaggcgtggatgcgaaagcgatactgagtgcccgcctgtcgaaatctcgccgtctcgaaaatctgattgcacagctgcccggcgaaaaaaaaaacggtctttttggcaatctgatcgcgctgtcactgggcctgacaccaaattttaagagcaacttcgacctggcagaggatgcgaagcttcaactgtcgaaggacacctatgacgatgatctggataatcttctggcacaaatcggtgatcagtatgcggatttattccttgcagcgaaaaacctatctgacgcaattctgttgagcgatatcctccgcgtcaacaccgaaatcactaaagcccccctgtcagcgtcgatgattaaacgttatgatgagcaccatcaggatctgaccttgctaaaggcgctggtgcgacagcagcttcccgaaaaatataaagagatcttttttgatcaatcgaagaatggttatgccggatacattgatggcggagccagtcaggaagaattttacaaattcatcaaaccgatcctggaaaaaatggatggcacagaagaactgcttgtgaaattgaaccgggaagatttactgcgcaaacagcgtacgttcgacaacggctccataccccatcagattcacttaggtgagctgcatgcaatactccgtcgccaggaagatttttatccatttttaaaagacaaccgtgagaagattgaaaaaattttaacttttcgtattccatattacgtcgggcctttggcccgaggtaactctcgattcgcctggatgacgagaaaaagcgaggagaccatcactccgtggaattttgaagaggttgttgataaaggcgcgagcgcccagtcgtttatcgaacgtatgaccaactttgataaaaatctgccgaatgaaaaagtgcttccgaagcattctctgttgtatgaatatttcactgtgtacaatgagttaacgaaagtgaaatatgtgaccgaaggcatgcggaaacctgcttttctgtccggagaacagaaaaaagcaattgtggacctgctgttcaaaacgaaccggaaagtaactgtgaagcagctgaaagaggactacttcaaaaaaatcgaatgcttcgactcagtagagatctctggtgttgaagatcgcttcaacgcgagtctgggaacgtaccatgatttgttgaaaatcatcaaagataaagactttctggataacgaagagaatgaggacattcttgaagatattgttttgacactgactctgtttgaggatcgcgaaatgattgaagagcgcctgaaaacgtatgcccatttattcgatgacaaagtcatgaagcagctgaaacgtcgccgctatactgggtggggcagactttcacgtaaattgatcaatggtataagagacaaacagagcggcaaaactatcttagatttcctgaagagtgatggatttgccaaccggaattttatgcagcttatacatgatgactcgctaacgtttaaagaagacattcagaaggcgcaggtcagcggccagggtgattcgctgcatgaacacattgcaaatcttgccggatcgccagcgatcaaaaaaggcatccttcagacagtaaaagttgtggatgaactggtgaaagtaatgggtcgtcacaagccagaaaatattgtgatcgaaatggcccgggaaaatcagactactcaaaaaggtcagaaaaattctcgcgagcgtatgaaacgtattgaagaaggcatcaaagagctaggcagccagatattaaaggaacatccggttgagaacactcagctgcagaatgaaaaactgtatctgtattatcttcagaacggccgtgacatgtatgttgatcaagaactggatatcaatcgcttgtccgattatgacgtggatcatattgttccgcaaagctttctgaaagacgattctattgacaataaagtactgacacgttcggacaaaaaccgtggtaaaagcgataacgtaccgtcggaagaagttgttaagaaaatgaaaaattattggcgccaactcctgaatgctaaattgattacccagcggaaatttgataacttaaccaaagccgagcggggtggcttaagtgaactggataaagcgggttttattaaacgccaactggtagaaacccgccagataacgaaacatgtagctcaaatcctcgatagtcgcatgaatacgaaatatgacgaaaatgataaattgatccgtgaagtaaaagtgattactcttaaaagcaaattggtatctgattttcggaaagatttccaattctataaggtgagagaaattaacaattaccatcatgcacatgatgcgtatttaaatgcagttgttggcaccgccttaatcaaaaaatatccgaaattagaatctgagttcgtgtatggtgattataaagtttatgatgttcgaaaaatgattgctaagtctgaacaggaaatcggcaaagcgaccgcaaagtattttttttatagcaatattatgaatttttttaaaactgagattaccctggcgaatggcgaaattcgcaaacgtcctctgattgaaaccaatggcgaaaccggcgagatagtatgggacaagggccgtgattttgcgaccgtccggaaagtcctgtcaatgccgcaggtgaatattgtcaagaaaacagaagttcagacaggcggttttagtaaagagtctattctgcccaaacgtaattcggataaattgattgcccgcaagaaagattgggatccgaagaaatatggtggattcgattctccgacggtcgcctatagcgttctagtcgtcgccaaggtcgaaaaaggtaaatccaaaaaactgaaatctgtgaaagaactgttaggcattacaatcatggaacgtagtagttttgaaaagaacccgatcgacttcctcgaggcgaaaggctacaaagaagtcaagaaggatttgattattaaactcccaaaatattcattatttgagttagaaaacggtaggaagcgtatgctggcgagtgctggggaattacagaaagggaatgagttagcactgccgtcaaaatatgtgaactttctgtatctggcctcccattacgagaaactgaaaggtagcccggaagataatgaacagaaacaactatttgtcgagcaacacaaacattatctggatgaaattattgaacagattagtgaattctctaaacgtgttattttagcggatgccaaccttgacaaggtgctgagcgcatataataaacaccgtgataaacccattcgtgaacaggctgaaaatatcatacatctgttcacgttaaccaacttgggagctcctgccgcttttaaatatttcgataccacaattgaccgcaaacgttatacgtctacaaaagaggtgctcgatgcgaccctgatccaccagtctattacaggcctgtatgaaactcgtatcgacctgtcacaactgggcggcgactga

SEQ ID NO: 169 - DNA, 4107 bp, Artificial Sequence
  Description of Artificial Sequence: Synthetic polynucleotide
atggacaagaaatattcaatcggtttagcaataggaactaactcagtaggttgggctgtaattacagacgaatacaaggtaccgtccaaaaagtttaaggtgttggggaacacagatagacactctataaaaaaaaatttaataggcgctttacttttcgattcaggcgaaactgcagaagcgacacgtctgaagagaaccgctagacgtagatacacgaggagaaagaacagaatatgttacctacaagaaattttttctaatgagatggctaaggtggatgattcgttttttcatagactcgaagaatctttcttagttgaagaagataaaaaacacgaaaggcatcctatctttggaaacatagttgatgaggtggcttaccatgaaaaatatcccactatatatcaccttagaaaaaagttggttgattcaaccgacaaagcggatctaaggttaatttacctcgcgttggctcacatgataaaatttagaggacatttcttgatcgaaggtgatttaaatcccgataactctgatgtagataaactgttcatccagttggttcaaacatataatcagttgttcgaagagaaccccattaacgcatcaggtgttgatgctaaagcaatcttatcagcaaggttgagcaagagcagacgtctggaaaacttgattgcccaattgccaggtgaaaagaagaacggtctttttggaaatttaattgcactttcacttgggttgacaccgaattttaaaagcaatttcgacctcgctgaggatgctaaactccagttatctaaggatacatatgacgatgatttggataatctattggcccagataggtgatcagtatgcagatttgtttttggcagctaagaatttatcagatgcaattctactgagcgatattttaagggtgaatacagaaataactaaagcacctttgtctgcatctatgataaaaagatacgatgaacaccatcaagatctcacactattaaaagctttagttagacaacaattaccagaaaaatataaagaaatctttttcgatcagtccaagaacggatacgccggctatatagatggcggtgcctcccaagaagaattttacaaatttatcaaacccattttggaaaagatggatggtactgaagaattattggtcaaattaaacagggaagatttattaagaaaacaaaggacctttgataatggttctattccacaccaaatccatctaggggaattacatgcgattcttagaagacaagaagatttttatccattcttgaaagataacagggaaaagatagagaaaatcttaacttttagaattccctactacgtcgggcccttagctagggggaattctagattcgcctggatgacacgcaaatcagaagaaacaattacgccttggaattttgaagaagttgttgataaaggagcctctgctcaatcttttattgaacgaatgaccaattttgataagaatttacccaatgaaaaggtcttacccaaacattcactcctatacgagtactttactgtttacaatgagttgacaaaagtgaagtatgttaccgagggtatgcgaaaacctgctttcttgagtggtgaacaaaagaaggccattgttgacttgttattcaaaactaacagaaaggtcactgtgaagcagcttaaagaagattatttcaaaaagatcgaatgtttcgactcggtagaaattagtggtgtggaagatagatttaatgcttctcttggaacatatcatgatctactaaagatcatcaaagataaagatttcttggacaatgaagaaaatgaagatattcttgaagacatcgtgttgacacttacattgtttgaggacagagaaatgattgaagaaaggctgaagacctacgcccatttgtttgatgataaagtcatgaaacagttaaagaggagaaggtataccggatggggtaggctgtctcgcaaattgattaatggtattcgtgataaacaatcgggtaaaacaatcctagatttcctgaagtccgatggtttcgccaacaggaattttatgcaattgattcatgacgattctttgacttttaaagaggatattcagaaagcacaggtctcaggacagggcgattcactccatgaacatatagctaacctggctggctcccctgctattaagaaaggtatcttgcaaaccgtcaaagtagtagacgaacttgttaaagttatgggaagacacaaacctgaaaatatcgttattgaaatggctcgcgaaaaccagacaacacaaaagggtcaaaagaattcgagagagagaatgaagcgtatcgaagaaggtattaaagaacttgggtcccaaatacttaaagaacatccagtagaaaacactcagcttcaaaatgaaaaattatacttatattatcttcagaatggccgcgatatgtatgttgaccaagagttagatataaataggttgtctgattacgacgtggatcatattgtacctcaatcttttctaaaagatgattcaattgataataaggtattaacgagaagtgataaaaatagaggtaaatctgacaacgtgccaagcgaagaggtggtgaagaaaatgaaaaattattggcgtcaactgttgaacgccaagttaattacgcagagaaagtttgataatctaacaaaagctgaaagaggaggcctatctgagttagataaggccggttttatcaaacgtcagttagttgaaaccaggcaaatcacgaagcacgttgcccaaattctagattcaaggatgaataccaaatacgatgaaaacgataaactgattcgggaagtcaaggttataactctaaaaagcaaactagtttcagattttcgcaaagattttcaattttacaaagttcgagaaatcaataattatcatcatgctcacgacgcgtacttgaacgcggtcgttggtacagctttaataaagaaatatcctaaactggaatcggaatttgtatatggggattacaaagtatacgacgtgagaaagatgatcgctaaatctgaacaagaaattgggaaagcaactgccaaatattttttttacagcaacataatgaatttttttaaaacggaaattacattggcaaatggcgaaattagaaagcgcccattgatagagaccaatggagagactggggaaatcgtgtgggataaaggacgtgattttgccacagtgaggaaagtgttaagtatgccacaagttaatattgtaaaaaagaccgaggtccaaacgggtggatttagcaaagaatcaattttacctaagagaaattcagataaattaattgcccgcaaaaaggattgggatcctaaaaaatatggtggttttgattccccaacagttgcttactccgtcctagttgttgctaaggttgaaaaaggaaagtctaagaaacttaaatccgtaaaagagttactgggaattacaataatggaaagatcctctttcgaaaagaaccctattgacttcttggaggcgaaaggttataaagaagtcaaaaaagatttgatcataaaactaccaaagtattctctatttgaattggaaaacggcagaaaaaggatgttggcaagcgctggtgaactacaaaagggtaacgaattggcattgccgagtaaatacgtgaattttctatatttggcatcacattacgaaaagttaaagggatcacccgaggataacgagcagaaacaactgtttgttgaacaacacaaacattatcttgatgaaattatagaacaaattagtgagttcagtaagagagttattttagccgatgcaaatttagacaaagttttatctgcttataacaaacatagagataagcctataagggaacaagccgaaaatattattcatttgtttacgttaacaaatttaggggcaccagcagcattcaagtacttcgatacgactatcgatcgtaagcgttacacatctaccaaagaagttcttgatgcaactttgattcatcaatctataacaggcttatatgaaactagaatcgatctgtcacaacttggtggtgactaa

SEQ ID NO: 170 - DNA, 4107 bp, Artificial Sequence
  Description of Artificial Sequence: Synthetic polynucleotide
atggacaagaagtactcaattgggcttgctatcggcactaacagcgttggctgggcggtcatcacagacgaatataaggtcccatcaaagaaattcaaagtccttggcaatacggaccgacattcaatcaagaagaacctgattggagctctgctgtttgattccggtgaaaccgccgaggcaacacgattgaaacgtaccgctcgtaggaggtatacgcggcggaaaaataggatctgctatctgcaggaaatatttagcaacgaaatggccaaggtagacgacagcttcttccaccggctcgaggaatctttcctcgtggaagaagacaaaaagcacgagcgccaccccattttcggcaatatcgtggacgaggtagcttaccatgaaaagtatccaactatttaccacttacgtaagaagttagtggacagcaccgataaagccgaccttcgcctgatttacctagcacttgcacacatgattaagttccgaggccacttcttgatagagggagacctgaatcctgacaattccgatgtggataaattgttcatccagctggtacagacatacaatcagttgtttgaggaaaatccgattaatgccagtggcgtggacgccaaggctatcctgtctgctcggcttagtaagagtagacgcctggaaaatctaatcgcacagctgcccggcgaaaagaaaaatggactgttcggtaatttgatcgccctgagcctgggcctcacccctaactttaagtctaacttcgacctggccgaagatgctaagctccagctgtccaaagatacttacgatgacgatctcgataatctactggctcagatcggggaccagtacgctgacctgtttctagctgccaagaacctcagtgacgccattctcctgtccgatattctgagggttaacactgaaattacaaaggccccgctgagcgcgagcatgatcaaaaggtacgacgagcatcaccaggacctcacgctgctgaaggccttagtcagacagcaactgcccgaaaagtacaaagaaatctttttcgaccaatccaagaacgggtacgccggctacattgatggcggggcttcacaagaggagttttacaagtttatcaagcccatcctggagaaaatggacggcactgaagaactgcttgtgaaactcaatagggaagacttactgaggaaacagcgcacattcgataatggctccataccccaccaaatccatctgggagagttgcatgccatcttgcgaaggcaggaggacttctacccctttcttaaggacaacagggagaaaatcgagaaaattctgactttccgtatcccctactacgtgggcccacttgctcgcggaaactcacgattcgcatggatgaccagaaagtccgaggaaacaattacaccctggaattttgaggaggtagtagacaagggagccagcgctcaatctttcattgagaggatgacgaatttcgacaagaaccttccaaacgagaaagtgcttcctaagcacagcctgctgtatgagtatttcacggtgtacaacgaacttacgaaggtcaagtatgtgacagagggtatgcggaaacctgcttttctgtctggtgaacagaagaaagctatcgtcgatctcctgtttaaaaccaaccgaaaggtgacggtgaaacagttgaaggaggattacttcaagaagatcgagtgttttgattctgttgaaatttctggggtcgaggatagattcaacgccagcctgggcacctaccatgatttgctgaagattatcaaggataaggattttctggataatgaggagaatgaagacattttggaggatatagtgctgaccctcaccctgttcgaggaccgggagatgatcgaggagagactgaaaacatacgctcacctgtttgacgacaaggtcatgaagcagcttaagagacgccgttacacaggctggggaagattatcccgcaaattaatcaacgggatacgcgataaacaaagtggcaagaccatactcgacttcctaaagagcgatggattcgcaaatcgcaatttcatgcagttgatccacgacgatagcctgaccttcaaagaggacattcagaaagcgcaggtgagtggtcaaggggattccctgcacgaacacattgctaacttggctggatcaccagccattaagaaaggcatactgcagaccgttaaagtggtagatgagcttgtgaaagtcatgggaagacataagccagagaacatagtgatcgaaatggccagggaaaatcagaccacgcaaaaggggcagaagaactcaagagagcgtatgaagaggatcgaggagggcatcaaggagctgggtagccagatccttaaagagcacccagttgagaatacccagctgcagaatgagaaactttatctctattatctccagaacggaagggatatgtatgtcgaccaggaactggacatcaatcggctgagtgattatgacgtcgaccacattgtgcctcaaagctttctgaaggatgattccatcgacaataaagttctgacccggtctgataaaaatagaggcaaatccgacaacgtacctagcgaagaagtcgtcaaaaaaatgaagaactattggaggcagttgctgaatgccaagctgattacacaacgcaagtttgacaatctcaccaaggcagaaagggggggcctgtcagaactcgacaaagcaggtttcattaaaaggcagctagttgaaactaggcagattactaagcacgtggcccagatcctcgactcacggatgaatacaaagtatgatgagaatgataagctaatccgggaggtgaaggtgattactctgaaatctaagctggtgtcagatttcagaaaagacttccagttctacaaagtcagagagatcaacaattatcaccatgcccacgatgcatatcttaatgcagtagtggggacagctctgatcaaaaaatatcctaaactggagtctgaattcgtttatggtgactataaagtctatgacgtcagaaaaatgatcgcaaagagcgagcaggagatagggaaggccacagcaaagtacttcttttacagtaatatcatgaactttttcaaaactgagattacattggctaacggcgagatccgcaagcggccactgatagagactaacggagagacaggggagattgtttgggataagggccgtgacttcgccaccgttaggaaagtgctgtccatgccccaggtgaacattgtgaagaagacagaagtgcagacgggtgggttctcaaaagagtctattctgcctaagcggaatagtgacaaactgatcgcacgtaaaaaggactgggatccaaaaaagtacggcggattcgacagtcctaccgttgcatattccgtgcttgtggtcgctaaggtggagaagggaaaaagcaagaaactgaagtcagtcaaagaactactgggcataacgatcatggagcgctccagtttcgaaaaaaacccaatcgattttcttgaagccaagggatacaaggaggtaaagaaagaccttatcattaagctgcctaagtacagtctgttcgaactggagaatgggaggaagcgcatgctggcatcagctggagaactccaaaaagggaacgagttggccctcccctcaaagtatgtcaattttctctacctggcttctcactacgagaagttaaaggggtctccagaggataatgagcagaaacagctgtttgtggaacagcacaagcactatttggacgaaatcatcgaacaaatttccgagttcagtaagagggtgattctggccgacgcaaaccttgacaaagttctgtccgcatacaataagcacagagacaaaccaatccgcgagcaagccgagaatataattcaccttttcactctgactaatctgggggcccccgcagcatttaaatatttcgatacaacaatcgaccggaagcggtatacatctactaaggaagtcctcgatgcgacactgatccaccagtcaattacaggtttatatgaaacaagaatcgacctgtcccagctgggcggcgactag

SEQ ID NO: 171 - DNA, 4805 bp, Artificial Sequence; identical to SEQ ID NO: 69
  Description of Artificial Sequence: Synthetic polynucleotide

SEQ ID NO: 172 - DNA, 20 bp, Artificial Sequence
  Description of Artificial Sequence: Synthetic oligonucleotide
aattcaaaggataatcaaac

SEQ ID NO: 173 - DNA, 20 bp, Artificial Sequence
  Description of Artificial Sequence: Synthetic oligonucleotide
aatctctactctttgtagat

SEQ ID NO: 174 - DNA, 19 bp, Artificial Sequence
  Description of Artificial Sequence: Synthetic oligonucleotide
aatttctactgttgtagat

SEQ ID NO: 175 - DNA, 19 bp, Artificial Sequence
  Description of Artificial Sequence: Synthetic oligonucleotide
aatttctactagtgtagat

SEQ ID NO: 176 - DNA, 15 bp, Artificial Sequence
  Description of Artificial Sequence: Synthetic oligonucleotide
aatttctactattgt

SEQ ID NO: 177 - DNA, 18 bp, Artificial Sequence
  Description of Artificial Sequence: Synthetic oligonucleotide
aatttctactgttgtaga

SEQ ID NO: 178 - DNA, 16 bp, Artificial Sequence
  Description of Artificial Sequence: Synthetic oligonucleotide
aatttctactattgta

SEQ ID NO: 179 - DNA, 19 bp, Artificial Sequence
  Description of Artificial Sequence: Synthetic oligonucleotide
aatttctacttttgtagat

SEQ ID NO: 180 - DNA, 19 bp, Artificial Sequence
  Description of Artificial Sequence: Synthetic oligonucleotide
aatttctactgttgtagat

SEQ ID NO: 181 - DNA, 19 bp, Artificial Sequence
  Description of Artificial Sequence: Synthetic oligonucleotide
aatttctactcttgtagat

SEQ ID NO: 182 - DNA, 20 bp, Artificial Sequence
  Description of Artificial Sequence: Synthetic oligonucleotide
ttaactttgcgtaacaacgc

SEQ ID NO: 183 - DNA, 20 bp, Artificial Sequence
  Description of Artificial Sequence: Synthetic oligonucleotide
gtaattttgtatagaattta

SEQ ID NO: 184 - DNA, 22 bp, Unknown
  Description of Unknown: CRP binding site oligonucleotide
aaatgtgatctagatcacattt

SEQ ID NO: 185 - DNA, 20 bp, Unknown
  Description of Unknown: UP element oligonucleotide
aaaattttttttcaaaagta

SEQ ID NO: 186 - protein, 6 aa, Artificial Sequence
  Description of Artificial Sequence: Synthetic 6xHis tag
HHHHHH

SEQ ID NO: 187 - DNA, 24 bp, Artificial Sequence
  Description of Artificial Sequence: Synthetic oligonucleotide
accgtattgcagcagctttatcat

SEQ ID NO: 188 - protein, 8 aa, Artificial Sequence
  Description of Artificial Sequence: Synthetic peptide
TVLQQLYH

SEQ ID NO: 189 - DNA, 24 bp, Artificial Sequence
  Description of Artificial Sequence: Synthetic oligonucleotide
acggtattgcagcagctttaacat

SEQ ID NO: 190 - protein, 6 aa, Artificial Sequence
  Description of Artificial Sequence: Synthetic peptide
TVLQQL

SEQ ID NO: 191 - DNA, 52 bp, Artificial Sequence
  Description of Artificial Sequence: Synthetic oligonucleotide
  modified_base (19)..(33): a, c, t, g, unknown or other
actatcaatgggctaactnnnnnnnnnnnnnnntgaaacatctgcaactgcg

SEQ ID NO: 192 - DNA, 52 bp, Artificial Sequence
  Description of Artificial Sequence: Synthetic oligonucleotide
actatcaatgggctaactacgttcgtggcgtggtgaaacatctgcaactgcg

SEQ ID NO: 193 - DNA, 50 bp, Artificial Sequence
  Description of Artificial Sequence: Synthetic oligonucleotide
tcgtaaacgatatacgtctacaaaagaagttttagatgcgacctttatcc

SEQ ID NO: 194 - DNA, 50 bp, Artificial Sequence
  Description of Artificial Sequence: Synthetic oligonucleotide
tcgtaaaaattatacgtctacaaaagaagttttagatgcgacctttatcc

SEQ ID NO: 195 - DNA, 50 bp, Artificial Sequence
  Description of Artificial Sequence: Synthetic oligonucleotide
tcgtaaaaattatacgtctacaaaagaagttttaaatgcgacctttatcc

SEQ ID NO: 196 - DNA, 50 bp, Artificial Sequence
  Description of Artificial Sequence: Synthetic oligonucleotide
tcgtaaagtttatacgtctacaaaagaagttttagatgcgacctttatcc

SEQ ID NO: 197 - DNA, 50 bp, Artificial Sequence
  Description of Artificial Sequence: Synthetic oligonucleotide
tcgtaaaaaatatacgtctacaaaagaagttttacatgcgacctttatcc

SEQ ID NO: 198 - DNA, 50 bp, Artificial Sequence
  Description of Artificial Sequence: Synthetic oligonucleotide
tcgtaaacgatatacgtctacaaaagaagttttagatgccactcttatcc

SEQ ID NO: 199 - DNA, 26 bp, Artificial Sequence
  Description of Artificial Sequence: Synthetic oligonucleotide
ttgctttgagattctggagccgcggt

SEQ ID NO: 200 - DNA, 26 bp, Artificial Sequence
  Description of Artificial Sequence: Synthetic oligonucleotide
ttgcagggagattctggagcgtcggt

SEQ ID NO: 201 - DNA, 26 bp, Artificial Sequence
  Description of Artificial Sequence: Synthetic oligonucleotide
ttgctttgagattctggagcggcggt

SEQ ID NO: 202 - DNA, 26 bp, Artificial Sequence
  Description of Artificial Sequence: Synthetic oligonucleotide
ttgctttgagattctggagcgtcggt

SEQ ID NO: 203 - DNA, 26 bp, Artificial Sequence
  Description of Artificial Sequence: Synthetic oligonucleotide
taactacgttcgtggcgtggtgaaac

SEQ ID NO: 204 - DNA, 26 bp, Artificial Sequence
  Description of Artificial Sequence: Synthetic oligonucleotide
taactgccctaacggtccactgaaac

SEQ ID NO: 205 - DNA, 26 bp, Artificial Sequence
  Description of Artificial Sequence: Synthetic oligonucleotide
taactacactcataatcccctgaaac

SEQ ID NO: 206 - DNA, 23 bp, Artificial Sequence
  Description of Artificial Sequence: Synthetic oligonucleotide
gcgaatccggagtgtaagaaatg

SEQ ID NO: 207 - DNA, 23 bp, Artificial Sequence
  Description of Artificial Sequence: Synthetic oligonucleotide
gcgaattcaggaggtaagaaatg

SEQ ID NO: 208 - DNA, 35 bp, Artificial Sequence
  Description of Artificial Sequence: Synthetic oligonucleotide
ggtcggaacggtattgcagcagctttaacatctgc

SEQ ID NO: 209 - DNA, 35 bp, Artificial Sequence
  Description of Artificial Sequence: Synthetic oligonucleotide
ggtcggaaccgtattgcagcagctttatcatctgc

SEQ ID NO: 210 - DNA, 19 bp, Artificial Sequence
  Description of Artificial Sequence: Synthetic oligonucleotide
aaaatcagctgtgccgcaa

SEQ ID NO: 211 - DNA, 15 bp, Artificial Sequence
  Description of Artificial Sequence: Synthetic oligonucleotide
tccactggtatgcat

What is claimed is:

1. A method of genome engineering, the method comprising:
   a) contacting a population of cells with a polynucleotide, wherein each cell comprises a first target nucleic acid, a second target nucleic acid, and a nucleic acid-guided nuclease,
   wherein the polynucleotide comprises
      1) an editing cassette comprising:
         i) a modified first target nucleic acid sequence;
         ii) a first protospacer adjacent motif (PAM) mutation;
         iii) a first guide nucleic acid sequence targeting the first target nucleic acid and compatible with the nucleic acid-guided nuclease; and
      2) a recorder cassette comprising
         i) a barcode for tracking and identifying the modified first target nucleic acid sequence; and
         ii) a second guide nucleic acid sequence targeting the second target nucleic acid and compatible with the nucleic acid-guided nuclease;
   b) allowing the first guide nucleic acid sequence, the second guide nucleic acid sequence, and the nucleic acid-guided nuclease to create a genome edit within the first target nucleic acid and the second target nucleic acid; and
   c) using the PAM mutation to enrich for cells comprising the genome edit within the first target nucleic acid and second target nucleic acid.

2. The method of claim 1, further comprising d) sequencing the barcode, thereby identifying the modified first target nucleic acid that was inserted within the first target nucleic acid in step a).

3. The method of claim 1, wherein the nucleic acid-guided nuclease is a CRISPR nuclease.

4. The method of claim 1, wherein the PAM mutation is not recognized by the nucleic acid-guided nuclease.

5. The method of claim 1, wherein the nucleic acid-guided nuclease is a Type II or Type V Cas protein.

6. The method of claim 1, wherein the nucleic acid-guided nuclease is a Cas9 homologue or a Cpf1 homologue.

7. The method of claim 1, wherein the recorder cassette further comprises a second PAM mutation that is not recognized by the nucleic acid-guided nuclease.

8. A method of selectable recursive genetic engineering comprising
   a) contacting cells comprising a nucleic acid-guided nuclease with a polynucleotide comprising a recorder cassette, said recorder cassette comprising
      i) a nucleic acid sequence that recombines into a unique landing site incorporated during a previous round of engineering, wherein the nucleic acid sequence comprises a unique barcode; and
      ii) a guide RNA compatible with the nucleic acid-guided nuclease that targets the unique landing site; and
   b) allowing the nucleic acid-guided nuclease to edit the unique landing site, thereby incorporating the unique barcode into the unique landing site.

9. The method of claim 8, wherein the nucleic acid sequence further comprises a regulatory sequence that turns transcription of a screenable or selectable marker on or off.

10. The method of claim 8, wherein the nucleic acid sequence further comprises a PAM mutation that is not compatible with the nucleic acid-guided nuclease.

11. The method of claim 8, wherein the nucleic acid sequence further comprises a second unique landing site for subsequent engineering rounds.

12. The method of claim 8, wherein the polynucleotide further comprises an editing cassette comprising
   a) a modified first target nucleic acid sequence;
   b) a first protospacer adjacent motif (PAM) mutation; and
   c) a first guide nucleic acid sequence targeting the first target nucleic acid,
   wherein the modified first target nucleic acid can be tracked and identified by the unique barcode.

* * * * *